US008822417B2

(12) United States Patent
Andersen et al.

(10) Patent No.: US 8,822,417 B2
(45) Date of Patent: Sep. 2, 2014

(54) ALBUMIN VARIANTS

(75) Inventors: Jan Terje Andersen, Oslo (NO); Bjorn Dalhus, Hagen (NO); Inger Sandlie, Oslo (NO); Jason Cameron, Nottingham (GB); Andrew Plumridge, Derbyshire (GB); Esben Peter Friis, Herlev (DK); Karen Delahay, Nottingham (GB)

(73) Assignee: Novozymes Biopharma DIC A/S, Bagsvaerd (DK)

( * ) Notice: Subject to any disclaimer, the term of this patent is extended or adjusted under 35 U.S.C. 154(b) by 0 days.

(21) Appl. No.: 13/463,944

(22) Filed: May 4, 2012

(65) Prior Publication Data

US 2012/0322739 A1 Dec. 20, 2012

Related U.S. Application Data

(60) Provisional application No. 61/614,135, filed on Mar. 22, 2012, provisional application No. 61/551,598, filed on Oct. 26, 2011, provisional application No. 61/482,830, filed on May 5, 2011.

(30) Foreign Application Priority Data

May 5, 2011 (EP) .................................... 11164991
Oct. 13, 2011 (EP) .................................... 11185064
Mar. 16, 2012 (EP) .................................... 12160007

(51) Int. Cl.

| | |
|---|---|
| ***A61K 38/38*** | (2006.01) |
| ***C07K 14/765*** | (2006.01) |
| ***C12N 15/62*** | (2006.01) |
| ***C12N 15/14*** | (2006.01) |
| ***A61P 7/00*** | (2006.01) |
| ***C12N 15/63*** | (2006.01) |
| ***C12N 5/10*** | (2006.01) |
| ***B82Y 5/00*** | (2011.01) |

(52) U.S. Cl.

USPC .......... 514/15.2; 530/363; 530/324; 530/325; 530/326; 536/23.4; 536/23.5; 435/69.1; 435/69.7; 435/320.1; 435/254.2; 435/358; 435/369; 435/419; 977/773; 977/915

(58) Field of Classification Search

USPC ................ 514/15.2; 530/363, 324, 325, 326; 536/23.5, 23.4; 435/69.1, 69.7, 320.1, 435/254.2, 358, 369, 419; 977/773, 915

IPC .................... A61K 38/38; C07K 14/765; C12N 15/62, 15/14, 15/63, 1/19, 5/10; A61P 7/00; C12P 21/02; B82Y 5/00

See application file for complete search history.

(56) References Cited

U.S. PATENT DOCUMENTS

| | | | | |
|---|---|---|---|---|
| 5,948,609 | A * | 9/1999 | Carter et al. | 435/1.2 |
| 7,253,259 | B2 | 8/2007 | Otagiri | |
| 2002/0123080 | A1* | 9/2002 | Sonnenschein et al. | 435/7.23 |
| 2003/0091565 | A1* | 5/2003 | Beltzer et al. | 424/144.1 |
| 2003/0104578 | A1* | 6/2003 | Ballance | 435/69.4 |
| 2006/0051859 | A1 | 3/2006 | Fu | |

FOREIGN PATENT DOCUMENTS

| | | | |
|---|---|---|---|
| EP | 0286424 | A1 | 10/1988 |
| EP | 0510693 | A2 | 10/1992 |
| WO | 95/23857 | A1 | 9/1995 |
| WO | 99/28348 | A1 | 6/1999 |
| WO | 00/44772 | A2 | 8/2000 |
| WO | 00/069902 | A1 | 11/2000 |
| WO | 01/79480 | A1 | 10/2001 |
| WO | 2003/059934 | A2 | 7/2003 |
| WO | 2004/011499 | A1 | 2/2004 |
| WO | 2004/082640 | A2 | 9/2004 |
| WO | 2005/003296 | A2 | 1/2005 |
| WO | 2005/077042 | A2 | 8/2005 |
| WO | 2006/066595 | A2 | 6/2006 |
| WO | 2007/021494 | A2 | 2/2007 |
| WO | 2007/112940 | A2 | 10/2007 |
| WO | 2009/019314 | A1 | 2/2009 |
| WO | 2009/126920 | A2 | 10/2009 |
| WO | 2010/059315 | A1 | 5/2010 |
| WO | 2010/068278 | A2 | 6/2010 |
| WO | 2010/092135 | A2 | 8/2010 |
| WO | 2010/118169 | A2 | 10/2010 |
| WO | 2010/138814 | A2 | 12/2010 |
| WO | 2011/011315 | A1 | 1/2011 |
| WO | 2011/051489 | A2 | 5/2011 |
| WO | 2011/103076 | A1 | 8/2011 |
| WO | 2011/124718 | A1 | 10/2011 |
| WO | 2011/146902 | A1 | 11/2011 |
| WO | 2011/161127 | A1 | 12/2011 |
| WO | 2012/059486 | A1 | 5/2012 |

OTHER PUBLICATIONS

Andersen et al, 2006, Eur J Immunol 36, 3044-3051.
Andersen et al, 2012, Nat Commun 3, 1-9.
Anderson et al 2006, Trends Immunol 27(7), 343-348.
Anderson et al, 2010, Clinical Biochem 43, 367-372.
Anderson et al, 2010, J Biol Chem 285(7), 4826-4836.
Carlson et al, 1992, Proc Natl Acad Sci 89, 8225-8229.
Chaudhury et al, 2006, Biochemistry 45, 4983-4990.
Chen et al, 2003, Protein 52, 80-87.
lwao et al, 2007, Biochim Biophys Acta 1774, 1582-1590.

(Continued)

*Primary Examiner* — Julie Ha
*Assistant Examiner* — Erinne Dabkowski
(74) *Attorney, Agent, or Firm* — Michael W. Krenicky

(57) ABSTRACT

Variants of a parent albumin having altered plasma half-life compared with a parent albumin are described. Fusion polypeptides and conjugates including the variant albumin are also described. Embodiments include, but are not limited to, a polypeptide which is a variant of albumin, including one or more alterations at one or more positions corresponding to 104, 105, 106, 107, 108, 109, 110, 111, 112, 113, 114, 115, 116, 117, 118, 119 and 120 in SEQ ID NO: 2.

15 Claims, 50 Drawing Sheets
(14 of 50 Drawing Sheet(s) Filed in Color)

(56) References Cited

OTHER PUBLICATIONS

Kenanova et al, 2009, J Nucl Med 50 (Supp 2) 1582-Ab.
Kenanova et al, 2010, Prot Eng Design Selec 23(10), 789-798.
Kratz, 2008, J Controlled Release 132, 171-183.
Kurtzhals et al, 1995, Biochem J 312, 725-731.
Minchiotti et al, 1987, Biochim Biophys Acta 916, 411-418.
NCBI Database Access No. 103600-Albumin (2011).
Ober et al, 2001, Int Immunol 13, 1551-1559.
Otagiri et al, 2009, Biol Pharm Bull 32(4), 527-534.
Peach et al, 1991, Biochim Biophys Acta 1097, 49-54.
Peters, 1985, Adv Prot Chem 37, 161-245.
Peters, 1996, All About Albumin, Biochem 10.
Roopenian et al, 2007, Nat Rev Immunol 7, 715-525.
Roopenian et al, 2010, Methods Mol Biol 602, 93-104.
Sugio et al, 1999, Prot Eng 12(6), 439-446.
Takahashi et al, 1987, Proc Natl Acad Sci USA 84, 4413-4417.
Wani et al, 2006, Proc Natl Acad Sci USA 103(13), 5084-5089.
Werle et al, 2006, Amino Acids 30(4), 351-367.
Ward et al, 2009, Adv Immunol 103, 77-115.
West et al, 2000, Biochemistry 39(32), 9698-9708.
Zalevsky et al, 2010, Nat Biotech 28(2), 157-159.
Leger et al, 2003, Bioorganic Medical Chem Lttrs 13, 3571-3575.
Andersen et al, 2007, Clinic Chem 53(12), 2216.
Andersen et al, 2008, FEBS J 275(16), 4097-4110.
Andersen et al, 2009, Drug Metab Pharmacokinet 24(4), 318-332.
Bar-Or et al, 2006, Clin Chim Acta 365(1-2), 346-349.
Brennan et al, 2000, Biochim Biophys Acta 1481(2), 337-343.
Barash et al, 1993, Trans Res 2, 266-276.
Burmeister et al, 1994, Nature 372(6504), 336-343.
Burmeister et al, 1994, Nature 372(6504), 379-383.
Cronican et al, 2010—Geneseq, Access No. AXS56687.
Chaudhury et al, 2003, J Exp Med 197(3), 315-322.
Dagnino et al, 2010, Clinic Chimica Acta 411, 1711-1715.
Iwao et al, 2009, Biochem Biophys Acta 1794(4), 634-641.
Curry et al, 1998, Nat Stuct Biol 5(9), 827-835.
Elble, 1992, Biotechniques 13(1), 18-20.
Farran et al, 2002, Trans Res 11, 337-346.
Fleer et al, 1991, Biotech 9, 968-975.
Iwao et al, 2006, Biochim Biophys Acta 1764(4), 743-749.
Hansen et al, 2005, Biochim Biophys Acta 1747(1), 81-88.
Hillier et al, 2007, Nature 434, 724-731—Uniprot, Access No. A6NBZ8.
Ishima et al, 2007, J Pharma Exp Therapeutics 320(3), 969-977.
Ito et al, 1983, J Bacteriol 153(1), 163-168.
NCP Web Catalog, 2005, 1-36.
Kenanova et al, 2005, Cancer Res 65(2), 622-631.
Kenanova et al, 2007, Cancer Res 67(2), 718-726.
Kenanova et al, 2009, J Nucl Med 50(2), 1582.
Kobayashi et al, 1998, Thera Apheresis 2, 257-262.
Kuo et al, 2010, J Clin Immunol 30(6), 777-789.
Li et al, 2001, Intl Immunol 13(12), 1515-1523.
McGregor, 2008, Curr Opin Pharmacol 8(5), 616-619.
Mezo et al, 2010. J Biol Chem 285(36), 27694-27701.
Minchiotti et al, 2008, Human Mutation 29(8), 1007-1016.
Montoyo et al, 2009, Proc Natl Acad Sci USA 106(8), 2788-2793.
Needleman et al, 1970, J Mol Biol 48, 443-453.
Ober et al, 2004, J Immunol 172(4), 2021-2029.
Ober et al, 2004, Proc Natl Acad Sci USA 101(30), 11076-11081.
Olafsen et al, 2006, Nature Protocol 1(4), 2048-2060.
Peters et al, 1997, All About Albumin Review, Clin Chem 43, 2014a-2015a.
Prabhat et al, 2007, Proc Natl Acad Sci USA 104(14), 5889-5894.
Rice et al, 2000, Trends Genet 16, 276-277.
Roopenian et al, 2003, J Immunol 170(7), 3528-3533.
Sheffield et al, 2000, Thrombosis Research 99(6), 613-621.
Sijmons et al, 1990, Biotech 8, 217-221.
Simard et al, 2005, Proc Natl Acad Sci USA 102(50), 17958-17963.
Sleep et al, 1990, Biotechnology 8, 42-46.
Sleep et al, 1991, Nature Biotechnol 9(2), 183-187.
Sleep et al, 2001, Yeast, 18(5), 403-421.
Stehle et al, 1997, Crit Rev Oncol Hematol 26(2), 77-100.

* cited by examiner

Figure 4
A
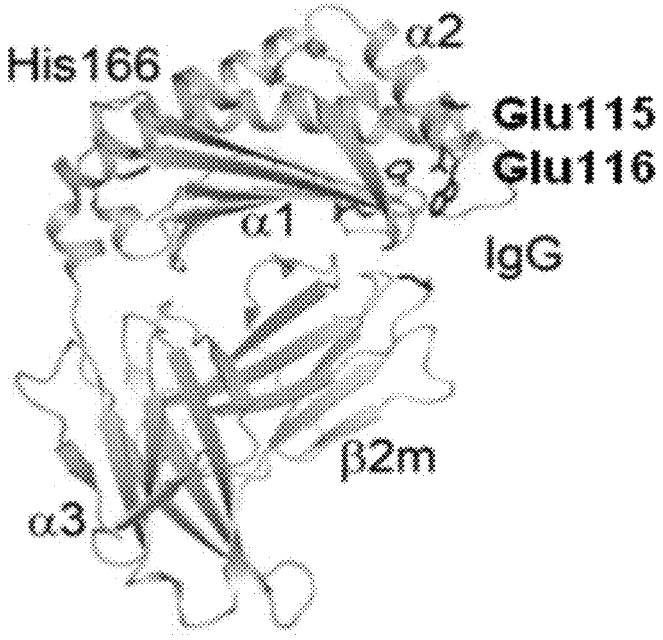
B
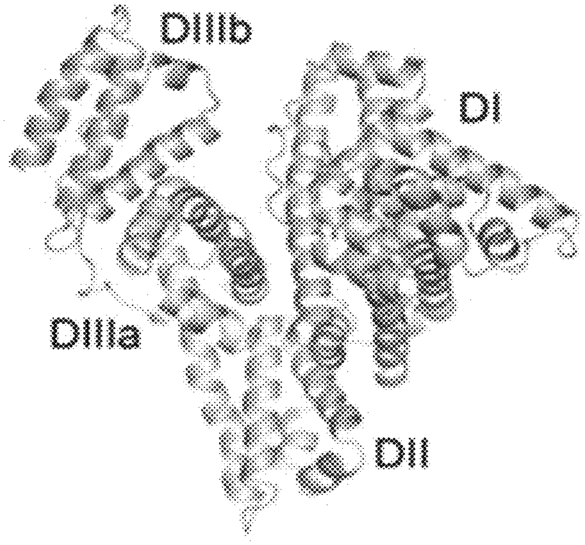

Figure 4 (continued)
C
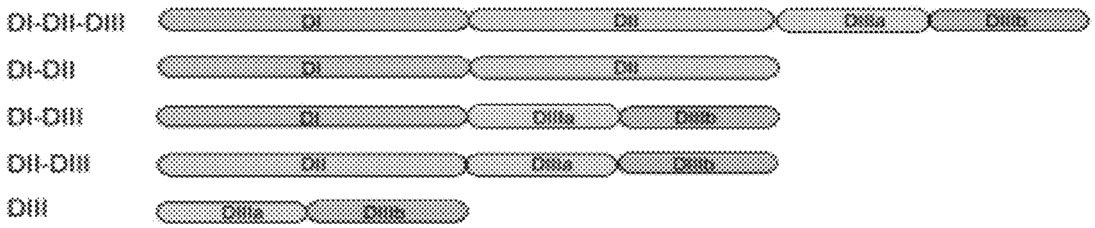
D
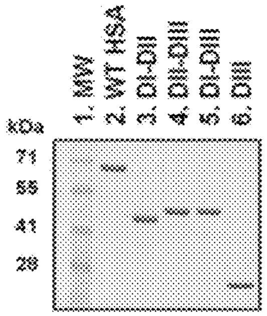
E
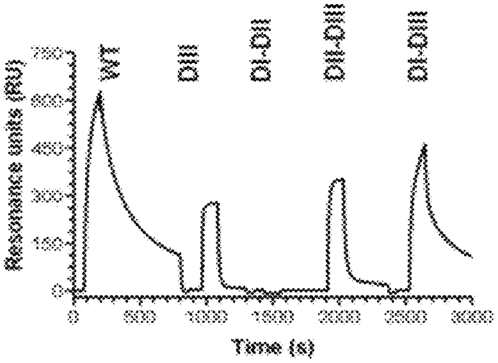
F
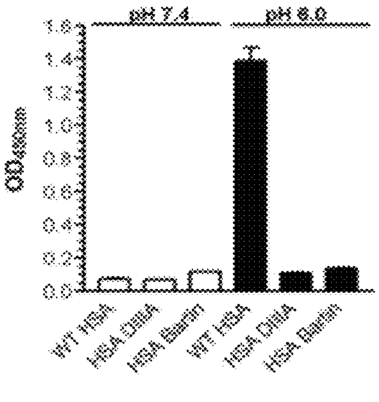

| | | | | | | | | | | | |
|---|---|---|---|---|---|---|---|---|---|---|---|
| ATOM | 1 | CA | SER | A | 5 | 35.484 | 34.403 | 99.560 | 1.00 | 17.84 | C |
| ATOM | 2 | CA | GLU | A | 6 | 31.980 | 35.139 | 98.374 | 1.00 | 15.01 | C |
| ATOM | 3 | CA | VAL | A | 7 | 31.566 | 32.551 | 95.609 | 1.00 | 21.16 | C |
| ATOM | 4 | CA | ALA | A | 8 | 32.733 | 30.037 | 98.250 | 1.00 | 16.88 | C |
| ATOM | 5 | CA | HIS | A | 9 | 30.306 | 31.290 | 100.849 | 1.00 | 18.86 | C |
| ATOM | 6 | CA | ARG | A | 10 | 27.945 | 31.288 | 98.264 | 1.00 | 11.81 | C |
| ATOM | 7 | CA | PHE | A | 11 | 28.746 | 27.918 | 96.894 | 1.00 | 11.63 | C |
| ATOM | 8 | CA | LYS | A | 12 | 28.534 | 26.477 | 100.358 | 1.00 | 16.95 | C |
| ATOM | 9 | CA | ASP | A | 13 | 25.078 | 27.907 | 100.980 | 1.00 | 15.26 | C |
| ATOM | 10 | CA | LEU | A | 14 | 23.333 | 26.662 | 97.811 | 1.00 | 8.28 | C |
| ATOM | 11 | CA | GLY | A | 15 | 25.178 | 23.407 | 97.083 | 1.00 | 10.64 | C |
| ATOM | 12 | CA | GLU | A | 16 | 26.973 | 22.676 | 93.817 | 1.00 | 17.40 | C |
| ATOM | 13 | CA | GLU | A | 17 | 23.679 | 21.763 | 92.253 | 1.00 | 22.85 | C |
| ATOM | 14 | CA | ASN | A | 18 | 21.683 | 25.003 | 92.466 | 1.00 | 19.35 | C |
| ATOM | 15 | CA | PHE | A | 19 | 24.869 | 27.112 | 92.390 | 1.00 | 12.88 | C |
| ATOM | 16 | CA | LYS | A | 20 | 25.805 | 25.678 | 89.040 | 1.00 | 7.75 | C |
| ATOM | 17 | CA | ALA | A | 21 | 22.192 | 26.063 | 87.783 | 1.00 | 5.09 | C |
| ATOM | 18 | CA | LEU | A | 22 | 21.873 | 29.699 | 88.904 | 1.00 | 8.72 | C |
| ATOM | 19 | CA | VAL | A | 23 | 25.199 | 30.516 | 87.292 | 1.00 | 5.36 | C |
| ATOM | 20 | CA | LEU | A | 24 | 23.780 | 29.286 | 83.954 | 1.00 | 6.90 | C |
| ATOM | 21 | CA | ILE | A | 25 | 20.753 | 31.547 | 84.383 | 1.00 | 3.87 | C |
| ATOM | 22 | CA | ALA | A | 26 | 22.807 | 34.668 | 85.230 | 1.00 | 4.93 | C |
| ATOM | 23 | CA | PHE | A | 27 | 24.969 | 34.228 | 82.155 | 1.00 | 8.16 | C |
| ATOM | 24 | CA | ALA | A | 28 | 22.006 | 33.240 | 79.967 | 1.00 | 11.21 | C |
| ATOM | 25 | CA | GLN | A | 29 | 20.069 | 36.340 | 81.019 | 1.00 | 4.93 | C |
| ATOM | 26 | CA | TYR | A | 30 | 23.044 | 38.609 | 80.396 | 1.00 | 7.84 | C |
| ATOM | 27 | CA | LEU | A | 31 | 24.041 | 37.126 | 77.046 | 1.00 | 5.67 | C |
| ATOM | 28 | CA | GLN | A | 32 | 20.682 | 35.886 | 75.364 | 1.00 | 4.46 | C |
| ATOM | 29 | CA | GLN | A | 33 | 22.052 | 35.418 | 71.800 | 1.00 | 11.82 | C |
| ATOM | 30 | CA | CYS | A | 34 | 24.374 | 33.267 | 73.149 | 1.00 | 21.43 | C |
| ATOM | 31 | CA | PRO | A | 35 | 24.948 | 29.496 | 72.411 | 1.00 | 19.58 | C |
| ATOM | 32 | CA | PHE | A | 36 | 24.163 | 26.896 | 75.073 | 1.00 | 15.34 | C |
| ATOM | 33 | CA | GLU | A | 37 | 27.342 | 24.860 | 74.522 | 1.00 | 23.40 | C |
| ATOM | 34 | CA | ASP | A | 38 | 29.313 | 28.040 | 75.308 | 1.00 | 22.74 | C |
| ATOM | 35 | CA | HIS | A | 39 | 27.288 | 28.920 | 78.409 | 1.00 | 16.34 | C |
| ATOM | 36 | CA | VAL | A | 40 | 27.850 | 25.333 | 79.555 | 1.00 | 20.01 | C |
| ATOM | 37 | CA | LYS | A | 41 | 31.661 | 25.674 | 79.537 | 1.00 | 21.72 | C |
| ATOM | 38 | CA | LEU | A | 42 | 31.774 | 29.083 | 81.168 | 1.00 | 21.51 | C |
| ATOM | 39 | CA | VAL | A | 43 | 29.612 | 27.761 | 84.011 | 1.00 | 20.26 | C |
| ATOM | 40 | CA | ASN | A | 44 | 31.715 | 24.654 | 84.198 | 1.00 | 21.19 | C |
| ATOM | 41 | CA | GLU | A | 45 | 34.824 | 26.924 | 84.474 | 1.00 | 20.69 | C |
| ATOM | 42 | CA | VAL | A | 46 | 33.278 | 29.179 | 87.098 | 1.00 | 23.89 | C |
| ATOM | 43 | CA | THR | A | 47 | 32.168 | 26.053 | 88.973 | 1.00 | 23.97 | C |
| ATOM | 44 | CA | GLU | A | 48 | 35.555 | 24.465 | 88.811 | 1.00 | 26.36 | C |
| ATOM | 45 | CA | PHE | A | 49 | 36.914 | 27.743 | 90.253 | 1.00 | 15.47 | C |
| ATOM | 46 | CA | ALA | A | 50 | 34.409 | 27.949 | 93.064 | 1.00 | 10.33 | C |

Figure 18 (continued)

| | | | | | | | | | | | |
|---|---|---|---|---|---|---|---|---|---|---|---|
| ATOM | 47 | CA | LYS | A | 51 | 35.586 | 24.614 | 94.349 | 1.00 | 15.40 | C |
| ATOM | 48 | CA | THR | A | 52 | 39.236 | 25.610 | 94.796 | 1.00 | 23.90 | C |
| ATOM | 49 | CA | CYS | A | 53 | 37.910 | 28.518 | 96.782 | 1.00 | 25.87 | C |
| ATOM | 50 | CA | VAL | A | 54 | 35.904 | 26.143 | 98.967 | 1.00 | 31.74 | C |
| ATOM | 51 | CA | ALA | A | 55 | 39.025 | 24.135 | 99.614 | 1.00 | 30.55 | C |
| ATOM | 52 | CA | ASP | A | 56 | 40.995 | 27.316 | 100.354 | 1.00 | 36.99 | C |
| ATOM | 53 | CA | GLU | A | 57 | 39.419 | 30.746 | 100.806 | 1.00 | 35.99 | C |
| ATOM | 54 | CA | SER | A | 58 | 42.915 | 32.229 | 100.405 | 1.00 | 39.67 | C |
| ATOM | 55 | CA | ALA | A | 59 | 43.367 | 30.941 | 96.949 | 1.00 | 36.16 | C |
| ATOM | 56 | CA | GLU | A | 60 | 44.204 | 33.092 | 93.966 | 1.00 | 39.76 | C |
| ATOM | 57 | CA | ASN | A | 61 | 41.112 | 35.174 | 93.238 | 1.00 | 25.80 | C |
| ATOM | 58 | CA | CYS | A | 62 | 38.726 | 33.820 | 95.847 | 1.00 | 21.30 | C |
| ATOM | 59 | CA | ASP | A | 63 | 38.211 | 37.290 | 97.243 | 1.00 | 19.35 | C |
| ATOM | 60 | CA | LYS | A | 64 | 36.631 | 38.071 | 94.149 | 1.00 | 10.09 | C |
| ATOM | 61 | CA | SER | A | 65 | 33.130 | 40.142 | 94.019 | 1.00 | 9.91 | C |
| ATOM | 62 | CA | LEU | A | 66 | 30.911 | 37.775 | 92.133 | 1.00 | 11.02 | C |
| ATOM | 63 | CA | HIS | A | 67 | 30.314 | 40.409 | 89.500 | 1.00 | 9.49 | C |
| ATOM | 64 | CA | THR | A | 68 | 34.030 | 40.814 | 88.804 | 1.00 | 9.64 | C |
| ATOM | 65 | CA | LEU | A | 69 | 34.411 | 37.027 | 88.413 | 1.00 | 8.22 | C |
| ATOM | 66 | CA | PHE | A | 70 | 31.152 | 36.520 | 86.566 | 1.00 | 6.93 | C |
| ATOM | 67 | CA | GLY | A | 71 | 31.853 | 39.324 | 84.140 | 1.00 | 16.91 | C |
| ATOM | 68 | CA | ASP | A | 72 | 35.399 | 38.453 | 83.097 | 1.00 | 15.12 | C |
| ATOM | 69 | CA | LYS | A | 73 | 34.126 | 35.028 | 82.072 | 1.00 | 12.86 | C |
| ATOM | 70 | CA | LEU | A | 74 | 31.162 | 36.442 | 80.217 | 1.00 | 2.92 | C |
| ATOM | 71 | CA | CYS | A | 75 | 33.552 | 38.781 | 78.461 | 1.00 | 10.07 | C |
| ATOM | 72 | CA | THR | A | 76 | 35.867 | 35.984 | 77.300 | 1.00 | 18.11 | C |
| ATOM | 73 | CA | VAL | A | 77 | 33.047 | 35.596 | 74.735 | 1.00 | 20.11 | C |
| ATOM | 74 | CA | ALA | A | 78 | 31.149 | 38.890 | 74.664 | 1.00 | 34.23 | C |
| ATOM | 75 | CA | THR | A | 79 | 34.046 | 40.824 | 73.097 | 1.00 | 47.40 | C |
| ATOM | 76 | CA | LEU | A | 80 | 33.115 | 39.681 | 69.590 | 1.00 | 61.87 | C |
| ATOM | 77 | CA | ARG | A | 81 | 30.656 | 41.991 | 67.868 | 1.00 | 72.14 | C |
| ATOM | 78 | CA | GLU | A | 82 | 30.394 | 40.235 | 64.487 | 1.00 | 76.50 | C |
| ATOM | 79 | CA | THR | A | 83 | 28.151 | 38.041 | 66.647 | 1.00 | 77.09 | C |
| ATOM | 80 | CA | TYR | A | 84 | 27.072 | 40.143 | 69.676 | 1.00 | 73.80 | C |
| ATOM | 81 | CA | GLY | A | 85 | 27.579 | 43.706 | 68.554 | 1.00 | 71.15 | C |
| ATOM | 82 | CA | GLU | A | 86 | 26.823 | 46.277 | 71.293 | 1.00 | 67.75 | C |
| ATOM | 83 | CA | MET | A | 87 | 27.587 | 43.960 | 74.209 | 1.00 | 54.56 | C |
| ATOM | 84 | CA | ALA | A | 88 | 31.337 | 44.433 | 73.677 | 1.00 | 39.79 | C |
| ATOM | 85 | CA | ASP | A | 89 | 31.386 | 47.935 | 75.204 | 1.00 | 32.76 | C |
| ATOM | 86 | CA | CYS | A | 90 | 30.334 | 46.704 | 78.665 | 1.00 | 20.67 | C |
| ATOM | 87 | CA | CYS | A | 91 | 33.390 | 44.499 | 78.929 | 1.00 | 14.89 | C |
| ATOM | 88 | CA | ALA | A | 92 | 35.311 | 47.671 | 77.838 | 1.00 | 15.53 | C |
| ATOM | 89 | CA | LYS | A | 93 | 34.186 | 49.002 | 81.244 | 1.00 | 15.23 | C |
| ATOM | 90 | CA | GLN | A | 94 | 34.735 | 47.743 | 84.835 | 1.00 | 10.79 | C |
| ATOM | 91 | CA | GLU | A | 95 | 32.652 | 46.796 | 87.877 | 1.00 | 5.59 | C |
| ATOM | 92 | CA | PRO | A | 96 | 30.301 | 48.189 | 88.749 | 1.00 | 3.03 | C |

Figure 18 (continued)

| | | | | | | | | | | | |
|---|---|---|---|---|---|---|---|---|---|---|---|
| ATOM | 93 | CA | GLU | A | 97 | 29.862 | 50.192 | 85.560 | 1.00 | 14.06 | C |
| ATOM | 94 | CA | ARG | A | 98 | 30.171 | 46.949 | 83.526 | 1.00 | 9.43 | C |
| ATOM | 95 | CA | ASN | A | 99 | 27.422 | 44.991 | 85.365 | 1.00 | 9.98 | C |
| ATOM | 96 | CA | GLU | A | 100 | 25.398 | 48.207 | 85.263 | 1.00 | 13.28 | C |
| ATOM | 97 | CA | CYS | A | 101 | 25.810 | 48.160 | 81.500 | 1.00 | 13.65 | C |
| ATOM | 98 | CA | PHE | A | 102 | 24.368 | 44.406 | 81.208 | 1.00 | 11.67 | C |
| ATOM | 99 | CA | LEU | A | 103 | 21.565 | 44.989 | 82.900 | 1.00 | 11.58 | C |
| ATOM | 100 | CA | GLN | A | 104 | 21.021 | 47.972 | 80.689 | 1.00 | 14.85 | C |
| ATOM | 101 | CA | HIS | A | 105 | 21.108 | 45.536 | 77.693 | 1.00 | 16.85 | C |
| ATOM | 102 | CA | LYS | A | 106 | 18.715 | 42.801 | 78.788 | 1.00 | 17.22 | C |
| ATOM | 103 | CA | ASP | A | 107 | 16.341 | 42.366 | 75.799 | 1.00 | 9.99 | C |
| ATOM | 104 | CA | ASP | A | 108 | 12.692 | 41.833 | 76.617 | 1.00 | 17.00 | C |
| ATOM | 105 | CA | ASN | A | 109 | 11.796 | 40.527 | 73.166 | 1.00 | 17.38 | C |
| ATOM | 106 | CA | PRO | A | 110 | 14.949 | 38.986 | 71.743 | 1.00 | 14.82 | C |
| ATOM | 107 | CA | ASN | A | 111 | 14.976 | 38.135 | 68.069 | 1.00 | 36.51 | C |
| ATOM | 108 | CA | LEU | A | 112 | 15.070 | 34.430 | 68.922 | 1.00 | 34.46 | C |
| ATOM | 109 | CA | PRO | A | 113 | 13.860 | 31.366 | 66.940 | 1.00 | 37.65 | C |
| ATOM | 110 | CA | ARG | A | 114 | 10.446 | 30.365 | 68.130 | 1.00 | 42.65 | C |
| ATOM | 111 | CA | LEU | A | 115 | 10.920 | 27.307 | 70.291 | 1.00 | 40.30 | C |
| ATOM | 112 | CA | VAL | A | 116 | 9.113 | 24.253 | 69.082 | 1.00 | 35.44 | C |
| ATOM | 113 | CA | ARG | A | 117 | 8.917 | 20.950 | 70.838 | 1.00 | 31.86 | C |
| ATOM | 114 | CA | PRO | A | 118 | 9.881 | 17.689 | 69.162 | 1.00 | 29.57 | C |
| ATOM | 115 | CA | GLU | A | 119 | 7.697 | 14.584 | 69.325 | 1.00 | 30.54 | C |
| ATOM | 116 | CA | VAL | A | 120 | 7.190 | 12.967 | 72.680 | 1.00 | 24.49 | C |
| ATOM | 117 | CA | ASP | A | 121 | 9.426 | 10.070 | 71.682 | 1.00 | 36.49 | C |
| ATOM | 118 | CA | VAL | A | 122 | 12.265 | 12.317 | 70.631 | 1.00 | 33.13 | C |
| ATOM | 119 | CA | MET | A | 123 | 12.064 | 14.209 | 73.929 | 1.00 | 24.64 | C |
| ATOM | 120 | CA | CYS | A | 124 | 11.733 | 11.190 | 76.261 | 1.00 | 19.82 | C |
| ATOM | 121 | CA | THR | A | 125 | 14.803 | 9.603 | 74.740 | 1.00 | 15.02 | C |
| ATOM | 122 | CA | ALA | A | 126 | 17.018 | 12.709 | 74.981 | 1.00 | 12.34 | C |
| ATOM | 123 | CA | PHE | A | 127 | 15.743 | 12.914 | 78.428 | 1.00 | 16.16 | C |
| ATOM | 124 | CA | HIS | A | 128 | 16.955 | 9.440 | 79.311 | 1.00 | 29.14 | C |
| ATOM | 125 | CA | ASP | A | 129 | 20.256 | 9.705 | 77.428 | 1.00 | 38.56 | C |
| ATOM | 126 | CA | ASN | A | 130 | 21.286 | 12.667 | 79.580 | 1.00 | 29.94 | C |
| ATOM | 127 | CA | GLU | A | 131 | 18.798 | 14.292 | 81.891 | 1.00 | 33.25 | C |
| ATOM | 128 | CA | GLU | A | 132 | 21.331 | 17.024 | 82.908 | 1.00 | 32.77 | C |
| ATOM | 129 | CA | THR | A | 133 | 22.027 | 18.309 | 79.415 | 1.00 | 25.76 | C |
| ATOM | 130 | CA | PHE | A | 134 | 18.265 | 17.937 | 78.884 | 1.00 | 17.85 | C |
| ATOM | 131 | CA | LEU | A | 135 | 17.325 | 20.227 | 81.766 | 1.00 | 20.19 | C |
| ATOM | 132 | CA | LYS | A | 136 | 20.258 | 22.521 | 81.310 | 1.00 | 16.74 | C |
| ATOM | 133 | CA | LYS | A | 137 | 18.612 | 23.183 | 77.876 | 1.00 | 9.83 | C |
| ATOM | 134 | CA | TYR | A | 138 | 15.550 | 24.083 | 79.508 | 1.00 | 6.96 | C |
| ATOM | 135 | CA | LEU | A | 139 | 16.828 | 26.573 | 82.125 | 1.00 | 7.56 | C |
| ATOM | 136 | CA | TYR | A | 140 | 18.939 | 26.042 | 79.361 | 1.00 | 8.17 | C |
| ATOM | 137 | CA | GLU | A | 141 | 16.026 | 28.822 | 76.941 | 1.00 | 5.60 | C |
| ATOM | 138 | CA | ILE | A | 142 | 13.435 | 29.831 | 79.482 | 1.00 | 2.01 | C |

Figure 18 (continued)

| | | | | | | | | | | | |
|---|---|---|---|---|---|---|---|---|---|---|---|
| ATOM | 139 | CA | ALA | A | 143 | 16.095 | 32.290 | 80.850 | 1.00 | 2.00 | C |
| ATOM | 140 | CA | ARG | A | 144 | 17.516 | 33.645 | 77.573 | 1.00 | 3.65 | C |
| ATOM | 141 | CA | ARG | A | 145 | 13.901 | 34.285 | 76.599 | 1.00 | 6.68 | C |
| ATOM | 142 | CA | HIS | A | 146 | 12.764 | 35.027 | 79.851 | 1.00 | 8.47 | C |
| ATOM | 143 | CA | PRO | A | 147 | 15.757 | 37.851 | 81.126 | 1.00 | 13.44 | C |
| ATOM | 144 | CA | TYR | A | 148 | 14.024 | 38.915 | 84.390 | 1.00 | 13.07 | C |
| ATOM | 145 | CA | PHE | A | 149 | 12.703 | 35.534 | 85.525 | 1.00 | 8.91 | C |
| ATOM | 146 | CA | TYR | A | 150 | 12.937 | 35.195 | 89.249 | 1.00 | 3.53 | C |
| ATOM | 147 | CA | ALA | A | 151 | 15.958 | 32.954 | 89.558 | 1.00 | 5.28 | C |
| ATOM | 148 | CA | PRO | A | 152 | 14.781 | 30.972 | 92.580 | 1.00 | 9.06 | C |
| ATOM | 149 | CA | GLU | A | 153 | 11.389 | 30.217 | 90.981 | 1.00 | 11.00 | C |
| ATOM | 150 | CA | LEU | A | 154 | 13.019 | 29.021 | 87.802 | 1.00 | 9.86 | C |
| ATOM | 151 | CA | LEU | A | 155 | 14.725 | 26.254 | 89.808 | 1.00 | 7.73 | C |
| ATOM | 152 | CA | PHE | A | 156 | 11.264 | 26.211 | 90.927 | 1.00 | 7.83 | C |
| ATOM | 153 | CA | PHE | A | 157 | 9.783 | 25.002 | 87.425 | 1.00 | 10.98 | C |
| ATOM | 154 | CA | ALA | A | 158 | 12.928 | 23.084 | 86.541 | 1.00 | 9.57 | C |
| ATOM | 155 | CA | LYS | A | 159 | 11.995 | 20.516 | 89.166 | 1.00 | 3.85 | C |
| ATOM | 156 | CA | ARG | A | 160 | 8.486 | 20.223 | 87.935 | 1.00 | 11.33 | C |
| ATOM | 157 | CA | TYR | A | 161 | 9.501 | 20.047 | 84.323 | 1.00 | 11.43 | C |
| ATOM | 158 | CA | LYS | A | 162 | 11.753 | 17.148 | 85.204 | 1.00 | 8.34 | C |
| ATOM | 159 | CA | ALA | A | 163 | 9.183 | 15.026 | 86.973 | 1.00 | 11.71 | C |
| ATOM | 160 | CA | ALA | A | 164 | 6.838 | 15.528 | 84.005 | 1.00 | 6.27 | C |
| ATOM | 161 | CA | PHE | A | 165 | 9.325 | 13.659 | 81.880 | 1.00 | 9.91 | C |
| ATOM | 162 | CA | THR | A | 166 | 10.294 | 11.149 | 84.500 | 1.00 | 12.33 | C |
| ATOM | 163 | CA | GLU | A | 167 | 6.714 | 10.177 | 85.258 | 1.00 | 15.61 | C |
| ATOM | 164 | CA | CYS | A | 168 | 5.229 | 10.623 | 81.775 | 1.00 | 14.42 | C |
| ATOM | 165 | CA | CYS | A | 169 | 8.019 | 6.705 | 79.971 | 1.00 | 17.14 | C |
| ATOM | 166 | CA | GLN | A | 170 | 7.308 | 5.450 | 81.803 | 1.00 | 12.70 | C |
| ATOM | 167 | CA | ALA | A | 171 | 3.591 | 5.892 | 81.334 | 1.00 | 10.95 | C |
| ATOM | 168 | CA | ALA | A | 172 | 1.587 | 3.773 | 78.910 | 1.00 | 13.12 | C |
| ATOM | 169 | CA | ASP | A | 173 | 0.228 | 6.707 | 76.993 | 1.00 | 16.37 | C |
| ATOM | 170 | CA | LYS | A | 174 | 3.224 | 9.013 | 77.183 | 1.00 | 21.67 | C |
| ATOM | 171 | CA | ALA | A | 175 | 1.899 | 11.753 | 74.876 | 1.00 | 19.91 | C |
| ATOM | 172 | CA | ALA | A | 176 | -1.322 | 12.183 | 76.925 | 1.00 | 17.93 | C |
| ATOM | 173 | CA | CYS | A | 177 | 0.424 | 12.202 | 80.250 | 1.00 | 11.55 | C |
| ATOM | 174 | CA | LEU | A | 178 | 3.017 | 14.652 | 79.165 | 1.00 | 14.20 | C |
| ATOM | 175 | CA | LEU | A | 179 | 1.593 | 17.036 | 76.628 | 1.00 | 13.26 | C |
| ATOM | 176 | CA | PRO | A | 180 | -0.867 | 18.577 | 79.120 | 1.00 | 13.06 | C |
| ATOM | 177 | CA | LYS | A | 181 | 1.934 | 19.040 | 81.608 | 1.00 | 15.29 | C |
| ATOM | 178 | CA | LEU | A | 182 | 4.333 | 20.871 | 79.323 | 1.00 | 3.69 | C |
| ATOM | 179 | CA | ASP | A | 183 | 1.285 | 22.908 | 78.494 | 1.00 | 8.08 | C |
| ATOM | 180 | CA | GLU | A | 184 | 0.733 | 23.817 | 82.087 | 1.00 | 10.46 | C |
| ATOM | 181 | CA | LEU | A | 185 | 4.286 | 24.804 | 82.867 | 1.00 | 12.50 | C |
| ATOM | 182 | CA | ARG | A | 186 | 4.654 | 26.807 | 79.661 | 1.00 | 18.22 | C |
| ATOM | 183 | CA | ASP | A | 187 | 1.454 | 28.602 | 80.471 | 1.00 | 25.71 | C |
| ATOM | 184 | CA | GLU | A | 188 | 2.411 | 29.209 | 84.136 | 1.00 | 16.95 | C |

Figure 18 (continued)

| | | | | | | | | | | |
|---|---|---|---|---|---|---|---|---|---|---|
| ATOM | 185 | CA | GLY | A | 189 | 5.950 | 30.203 | 83.393 | 1.00 | 10.00 | C |
| ATOM | 186 | CA | LYS | A | 190 | 4.828 | 33.129 | 81.208 | 1.00 | 7.73 | C |
| ATOM | 187 | CA | ALA | A | 191 | 2.609 | 34.381 | 84.036 | 1.00 | 4.68 | C |
| ATOM | 188 | CA | SER | A | 192 | 5.437 | 34.139 | 86.494 | 1.00 | 4.67 | C |
| ATOM | 189 | CA | SER | A | 193 | 7.744 | 35.833 | 84.072 | 1.00 | 6.27 | C |
| ATOM | 190 | CA | ALA | A | 194 | 5.402 | 38.744 | 83.568 | 1.00 | 2.01 | C |
| ATOM | 191 | CA | LYS | A | 195 | 4.706 | 39.088 | 87.296 | 1.00 | 4.31 | C |
| ATOM | 192 | CA | GLN | A | 196 | 8.459 | 39.448 | 88.151 | 1.00 | 7.96 | C |
| ATOM | 193 | CA | ARG | A | 197 | 9.197 | 41.912 | 85.303 | 1.00 | 3.56 | C |
| ATOM | 194 | CA | LEU | A | 198 | 6.683 | 44.051 | 87.105 | 1.00 | 2.03 | C |
| ATOM | 195 | CA | LYS | A | 199 | 9.655 | 43.751 | 90.342 | 1.00 | 6.23 | C |
| ATOM | 196 | CA | CYS | A | 200 | 11.860 | 44.021 | 88.597 | 1.00 | 5.66 | C |
| ATOM | 197 | CA | ALA | A | 201 | 10.062 | 47.650 | 86.701 | 1.00 | 7.63 | C |
| ATOM | 198 | CA | SER | A | 202 | 8.876 | 48.862 | 90.087 | 1.00 | 13.53 | C |
| ATOM | 199 | CA | LEU | A | 203 | 12.317 | 48.861 | 91.608 | 1.00 | 14.43 | C |
| ATOM | 200 | CA | GLN | A | 204 | 14.185 | 50.151 | 88.673 | 1.00 | 15.95 | C |
| ATOM | 201 | CA | LYS | A | 205 | 11.944 | 52.811 | 87.140 | 1.00 | 23.39 | C |
| ATOM | 202 | CA | PHE | A | 206 | 10.113 | 53.974 | 90.198 | 1.00 | 18.23 | C |
| ATOM | 203 | CA | GLY | A | 207 | 12.469 | 52.967 | 92.984 | 1.00 | 17.48 | C |
| ATOM | 204 | CA | GLU | A | 208 | 12.425 | 51.119 | 96.274 | 1.00 | 17.92 | C |
| ATOM | 205 | CA | ARG | A | 209 | 9.894 | 53.290 | 98.136 | 1.00 | 15.33 | C |
| ATOM | 206 | CA | ALA | A | 210 | 7.450 | 52.346 | 95.342 | 1.00 | 11.02 | C |
| ATOM | 207 | CA | PHE | A | 211 | 8.095 | 48.683 | 95.681 | 1.00 | 7.10 | C |
| ATOM | 208 | CA | LYS | A | 212 | 7.898 | 48.851 | 99.474 | 1.00 | 13.84 | C |
| ATOM | 209 | CA | ALA | A | 213 | 4.405 | 50.372 | 99.328 | 1.00 | 9.31 | C |
| ATOM | 210 | CA | TRP | A | 214 | 3.410 | 47.449 | 97.171 | 1.00 | 8.39 | C |
| ATOM | 211 | CA | ALA | A | 215 | 4.935 | 44.774 | 99.398 | 1.00 | 9.85 | C |
| ATOM | 212 | CA | VAL | A | 216 | 3.320 | 46.511 | 102.392 | 1.00 | 7.72 | C |
| ATOM | 213 | CA | ALA | A | 217 | -0.204 | 46.555 | 100.945 | 1.00 | 11.66 | C |
| ATOM | 214 | CA | ARG | A | 218 | 0.335 | 43.045 | 99.566 | 1.00 | 12.11 | C |
| ATOM | 215 | CA | LEU | A | 219 | 1.687 | 41.242 | 102.576 | 1.00 | 10.07 | C |
| ATOM | 216 | CA | SER | A | 220 | -0.882 | 43.013 | 104.742 | 1.00 | 7.82 | C |
| ATOM | 217 | CA | GLN | A | 221 | -3.789 | 41.631 | 102.719 | 1.00 | 8.53 | C |
| ATOM | 218 | CA | ARG | A | 222 | -2.349 | 38.198 | 102.847 | 1.00 | 15.25 | C |
| ATOM | 219 | CA | PHE | A | 223 | -1.378 | 38.385 | 106.586 | 1.00 | 15.79 | C |
| ATOM | 220 | CA | PRO | A | 224 | -4.042 | 40.581 | 108.218 | 1.00 | 22.31 | C |
| ATOM | 221 | CA | LYS | A | 225 | -3.281 | 39.050 | 111.602 | 1.00 | 32.78 | C |
| ATOM | 222 | CA | ALA | A | 226 | 0.415 | 38.953 | 111.493 | 1.00 | 27.13 | C |
| ATOM | 223 | CA | GLU | A | 227 | 1.668 | 42.994 | 113.371 | 1.00 | 32.57 | C |
| ATOM | 224 | CA | PHE | A | 228 | 3.151 | 46.003 | 111.583 | 1.00 | 30.35 | C |
| ATOM | 225 | CA | ALA | A | 229 | 6.631 | 45.435 | 113.084 | 1.00 | 22.93 | C |
| ATOM | 226 | CA | GLU | A | 230 | 6.324 | 42.030 | 111.549 | 1.00 | 17.30 | C |
| ATOM | 227 | CA | VAL | A | 231 | 4.917 | 42.900 | 108.200 | 1.00 | 14.73 | C |
| ATOM | 228 | CA | SER | A | 232 | 7.568 | 45.670 | 108.007 | 1.00 | 21.52 | C |
| ATOM | 229 | CA | LYS | A | 233 | 10.462 | 43.346 | 108.487 | 1.00 | 21.43 | C |
| ATOM | 230 | CA | LEU | A | 234 | 9.124 | 40.970 | 105.843 | 1.00 | 20.15 | C |

Figure 18 (continued)

| | | | | | | | | | | | |
|---|---|---|---|---|---|---|---|---|---|---|---|
| ATOM | 231 | CA | VAL | A | 235 | 8.719 | 43.918 | 103.489 | 1.00 | 14.89 | C |
| ATOM | 232 | CA | THR | A | 236 | 12.382 | 44.808 | 104.021 | 1.00 | 9.31 | C |
| ATOM | 233 | CA | ASP | A | 237 | 13.787 | 41.359 | 103.234 | 1.00 | 12.42 | C |
| ATOM | 234 | CA | LEU | A | 238 | 11.330 | 40.736 | 100.454 | 1.00 | 5.96 | C |
| ATOM | 235 | CA | THR | A | 239 | 12.724 | 43.988 | 99.025 | 1.00 | 6.17 | C |
| ATOM | 236 | CA | LYS | A | 240 | 16.290 | 42.815 | 99.217 | 1.00 | 2.40 | C |
| ATOM | 237 | CA | VAL | A | 241 | 15.359 | 39.550 | 97.584 | 1.00 | 4.72 | C |
| ATOM | 238 | CA | HIS | A | 242 | 13.885 | 41.259 | 94.544 | 1.00 | 8.03 | C |
| ATOM | 239 | CA | THR | A | 243 | 16.551 | 43.966 | 94.337 | 1.00 | 8.69 | C |
| ATOM | 240 | CA | GLU | A | 244 | 19.239 | 41.383 | 94.002 | 1.00 | 13.78 | C |
| ATOM | 241 | CA | CYS | A | 245 | 17.295 | 39.213 | 91.562 | 1.00 | 8.88 | C |
| ATOM | 242 | CA | CYS | A | 246 | 16.429 | 42.342 | 89.509 | 1.00 | 8.11 | C |
| ATOM | 243 | CA | HIS | A | 247 | 20.002 | 43.800 | 89.584 | 1.00 | 16.02 | C |
| ATOM | 244 | CA | GLY | A | 248 | 21.610 | 40.459 | 88.633 | 1.00 | 10.73 | C |
| ATOM | 245 | CA | ASP | A | 249 | 22.710 | 39.229 | 92.038 | 1.00 | 8.18 | C |
| ATOM | 246 | CA | LEU | A | 250 | 21.025 | 35.809 | 91.658 | 1.00 | 9.87 | C |
| ATOM | 247 | CA | LEU | A | 251 | 22.990 | 33.516 | 93.924 | 1.00 | 7.95 | C |
| ATOM | 248 | CA | GLU | A | 252 | 22.555 | 35.784 | 96.978 | 1.00 | 9.45 | C |
| ATOM | 249 | CA | CYS | A | 253 | 18.955 | 36.532 | 95.812 | 1.00 | 6.47 | C |
| ATOM | 250 | CA | ALA | A | 254 | 18.266 | 32.741 | 96.199 | 1.00 | 6.15 | C |
| ATOM | 251 | CA | ASP | A | 255 | 20.327 | 32.424 | 99.386 | 1.00 | 5.06 | C |
| ATOM | 252 | CA | ASP | A | 256 | 18.215 | 35.225 | 100.888 | 1.00 | 12.40 | C |
| ATOM | 253 | CA | ARG | A | 257 | 14.883 | 34.053 | 99.568 | 1.00 | 12.21 | C |
| ATOM | 254 | CA | ALA | A | 258 | 15.639 | 30.817 | 101.362 | 1.00 | 8.02 | C |
| ATOM | 255 | CA | ASP | A | 259 | 16.362 | 32.512 | 104.703 | 1.00 | 12.69 | C |
| ATOM | 256 | CA | LEU | A | 260 | 13.113 | 34.380 | 104.490 | 1.00 | 12.29 | C |
| ATOM | 257 | CA | ALA | A | 261 | 11.035 | 31.270 | 103.815 | 1.00 | 13.68 | C |
| ATOM | 258 | CA | LYS | A | 262 | 12.832 | 29.862 | 106.927 | 1.00 | 12.92 | C |
| ATOM | 259 | CA | TYR | A | 263 | 12.127 | 32.921 | 109.176 | 1.00 | 14.55 | C |
| ATOM | 260 | CA | ILE | A | 264 | 8.541 | 33.183 | 108.016 | 1.00 | 19.64 | C |
| ATOM | 261 | CA | CYS | A | 265 | 7.986 | 29.521 | 108.845 | 1.00 | 21.71 | C |
| ATOM | 262 | CA | GLU | A | 266 | 9.920 | 29.742 | 112.123 | 1.00 | 28.39 | C |
| ATOM | 263 | CA | ASN | A | 267 | 7.737 | 32.671 | 113.098 | 1.00 | 24.77 | C |
| ATOM | 264 | CA | GLN | A | 268 | 4.716 | 31.057 | 111.506 | 1.00 | 23.55 | C |
| ATOM | 265 | CA | ASP | A | 269 | 2.335 | 31.767 | 114.415 | 1.00 | 32.99 | C |
| ATOM | 266 | CA | SER | A | 270 | 2.636 | 35.553 | 114.253 | 1.00 | 33.29 | C |
| ATOM | 267 | CA | ILE | A | 271 | 2.360 | 35.886 | 110.462 | 1.00 | 19.42 | C |
| ATOM | 268 | CA | SER | A | 272 | -0.515 | 33.685 | 109.247 | 1.00 | 18.43 | C |
| ATOM | 269 | CA | SER | A | 273 | -2.162 | 30.307 | 109.805 | 1.00 | 24.67 | C |
| ATOM | 270 | CA | LYS | A | 274 | -2.598 | 29.277 | 106.178 | 1.00 | 25.13 | C |
| ATOM | 271 | CA | LEU | A | 275 | 1.150 | 28.683 | 106.211 | 1.00 | 22.99 | C |
| ATOM | 272 | CA | LYS | A | 276 | 1.249 | 25.370 | 108.145 | 1.00 | 33.39 | C |
| ATOM | 273 | CA | GLU | A | 277 | 1.248 | 23.372 | 104.879 | 1.00 | 35.45 | C |
| ATOM | 274 | CA | CYS | A | 278 | 4.081 | 25.110 | 103.016 | 1.00 | 26.67 | C |
| ATOM | 275 | CA | CYS | A | 279 | 6.409 | 24.972 | 105.959 | 1.00 | 30.21 | C |
| ATOM | 276 | CA | GLU | A | 280 | 6.637 | 21.168 | 105.718 | 1.00 | 37.29 | C |

Figure 18 (continued)

| | | | | | | | | | | | |
|---|---|---|---|---|---|---|---|---|---|---|---|
| ATOM | 277 | CA | LYS | A | 281 | 7.476 | 21.121 | 101.095 | 1.00 | 30.17 | C |
| ATOM | 278 | CA | PRO | A | 282 | 10.993 | 20.948 | 100.371 | 1.00 | 33.52 | C |
| ATOM | 279 | CA | LEU | A | 283 | 12.783 | 24.328 | 100.112 | 1.00 | 27.51 | C |
| ATOM | 280 | CA | LEU | A | 284 | 11.869 | 25.203 | 96.522 | 1.00 | 24.28 | C |
| ATOM | 281 | CA | GLU | A | 285 | 8.223 | 24.224 | 97.023 | 1.00 | 24.28 | C |
| ATOM | 282 | CA | LYS | A | 286 | 8.083 | 26.033 | 100.419 | 1.00 | 18.68 | C |
| ATOM | 283 | CA | SER | A | 287 | 9.018 | 29.438 | 98.906 | 1.00 | 18.84 | C |
| ATOM | 284 | CA | HIS | A | 288 | 6.657 | 28.964 | 96.008 | 1.00 | 16.29 | C |
| ATOM | 285 | CA | CYS | A | 289 | 3.859 | 28.049 | 98.408 | 1.00 | 15.41 | C |
| ATOM | 286 | CA | ILE | A | 290 | 4.531 | 30.848 | 100.807 | 1.00 | 10.36 | C |
| ATOM | 287 | CA | ALA | A | 291 | 4.846 | 33.203 | 97.851 | 1.00 | 14.79 | C |
| ATOM | 288 | CA | GLU | A | 292 | 1.465 | 32.012 | 96.583 | 1.00 | 24.45 | C |
| ATOM | 289 | CA | VAL | A | 293 | -0.759 | 31.158 | 99.474 | 1.00 | 24.19 | C |
| ATOM | 290 | CA | GLU | A | 294 | -4.196 | 32.606 | 100.114 | 1.00 | 24.83 | C |
| ATOM | 291 | CA | ASN | A | 295 | -5.194 | 35.355 | 102.546 | 1.00 | 23.18 | C |
| ATOM | 292 | CA | ASP | A | 296 | -5.565 | 34.510 | 106.244 | 1.00 | 29.52 | C |
| ATOM | 293 | CA | GLU | A | 297 | -8.771 | 35.399 | 108.079 | 1.00 | 36.67 | C |
| ATOM | 294 | CA | MET | A | 298 | -9.268 | 39.008 | 109.322 | 1.00 | 41.72 | C |
| ATOM | 295 | CA | PRO | A | 299 | -9.085 | 39.809 | 113.115 | 1.00 | 46.19 | C |
| ATOM | 296 | CA | ALA | A | 300 | -12.441 | 39.549 | 114.865 | 1.00 | 52.37 | C |
| ATOM | 297 | CA | ASP | A | 301 | -12.258 | 42.910 | 116.555 | 1.00 | 54.71 | C |
| ATOM | 298 | CA | LEU | A | 302 | -10.524 | 45.619 | 114.585 | 1.00 | 51.63 | C |
| ATOM | 299 | CA | PRO | A | 303 | -11.195 | 49.345 | 115.240 | 1.00 | 50.74 | C |
| ATOM | 300 | CA | SER | A | 304 | -12.618 | 51.954 | 112.883 | 1.00 | 45.10 | C |
| ATOM | 301 | CA | LEU | A | 305 | -9.804 | 53.447 | 110.791 | 1.00 | 38.20 | C |
| ATOM | 302 | CA | ALA | A | 306 | -11.078 | 57.045 | 111.048 | 1.00 | 34.79 | C |
| ATOM | 303 | CA | ALA | A | 307 | -10.125 | 57.071 | 114.777 | 1.00 | 32.98 | C |
| ATOM | 304 | CA | ASP | A | 308 | -6.309 | 57.197 | 114.408 | 1.00 | 33.52 | C |
| ATOM | 305 | CA | PHE | A | 309 | -6.152 | 58.643 | 110.894 | 1.00 | 23.06 | C |
| ATOM | 306 | CA | VAL | A | 310 | -8.986 | 61.100 | 110.543 | 1.00 | 35.65 | C |
| ATOM | 307 | CA | GLU | A | 311 | -10.413 | 61.695 | 113.969 | 1.00 | 45.51 | C |
| ATOM | 308 | CA | SER | A | 312 | -7.295 | 61.882 | 116.104 | 1.00 | 51.23 | C |
| ATOM | 309 | CA | LYS | A | 313 | -6.408 | 65.508 | 116.738 | 1.00 | 63.78 | C |
| ATOM | 310 | CA | ASP | A | 314 | -2.723 | 64.518 | 116.625 | 1.00 | 62.80 | C |
| ATOM | 311 | CA | VAL | A | 315 | -2.731 | 63.190 | 113.065 | 1.00 | 60.11 | C |
| ATOM | 312 | CA | CYS | A | 316 | -0.600 | 65.938 | 111.617 | 1.00 | 53.64 | C |
| ATOM | 313 | CA | LYS | A | 317 | 1.823 | 65.347 | 114.459 | 1.00 | 53.12 | C |
| ATOM | 314 | CA | ASN | A | 318 | 2.182 | 62.094 | 114.008 | 1.00 | 47.75 | C |
| ATOM | 315 | CA | TYR | A | 319 | 2.425 | 62.368 | 110.212 | 1.00 | 42.93 | C |
| ATOM | 316 | CA | ALA | A | 320 | 5.236 | 64.947 | 110.463 | 1.00 | 53.32 | C |
| ATOM | 317 | CA | GLU | A | 321 | 7.670 | 63.116 | 112.792 | 1.00 | 58.12 | C |
| ATOM | 318 | CA | ALA | A | 322 | 8.255 | 60.013 | 110.678 | 1.00 | 57.67 | C |
| ATOM | 319 | CA | LYS | A | 323 | 5.988 | 60.236 | 107.637 | 1.00 | 52.67 | C |
| ATOM | 320 | CA | ASP | A | 324 | 6.978 | 56.981 | 105.916 | 1.00 | 50.25 | C |
| ATOM | 321 | CA | VAL | A | 325 | 6.425 | 54.965 | 109.101 | 1.00 | 37.21 | C |
| ATOM | 322 | CA | PHE | A | 326 | 3.018 | 56.572 | 109.647 | 1.00 | 32.46 | C |

Figure 18 (continued)

| | | | | | | | | | | | |
|---|---|---|---|---|---|---|---|---|---|---|---|
| ATOM | 323 | CA | LEU | A | 327 | 2.132 | 56.194 | 105.956 | 1.00 | 27.72 | C |
| ATOM | 324 | CA | GLY | A | 328 | 3.099 | 52.551 | 105.876 | 1.00 | 30.75 | C |
| ATOM | 325 | CA | MET | A | 329 | 0.892 | 52.186 | 108.886 | 1.00 | 29.65 | C |
| ATOM | 326 | CA | PHE | A | 330 | -2.120 | 53.859 | 107.123 | 1.00 | 19.33 | C |
| ATOM | 327 | CA | LEU | A | 331 | -1.661 | 51.374 | 104.092 | 1.00 | 15.75 | C |
| ATOM | 328 | CA | TYR | A | 332 | -1.056 | 48.370 | 106.250 | 1.00 | 13.15 | C |
| ATOM | 329 | CA | GLU | A | 333 | -4.226 | 49.055 | 108.127 | 1.00 | 9.93 | C |
| ATOM | 330 | CA | TYR | A | 334 | -6.253 | 50.129 | 105.167 | 1.00 | 11.98 | C |
| ATOM | 331 | CA | ALA | A | 335 | -5.020 | 47.022 | 103.316 | 1.00 | 11.12 | C |
| ATOM | 332 | CA | ARG | A | 336 | -5.638 | 44.358 | 105.913 | 1.00 | 11.52 | C |
| ATOM | 333 | CA | ARG | A | 337 | -9.351 | 45.173 | 106.161 | 1.00 | 16.14 | C |
| ATOM | 334 | CA | HIS | A | 338 | -9.892 | 45.177 | 102.373 | 1.00 | 16.81 | C |
| ATOM | 335 | CA | PRO | A | 339 | -8.461 | 42.153 | 100.593 | 1.00 | 14.01 | C |
| ATOM | 336 | CA | ASP | A | 340 | -11.245 | 42.904 | 98.122 | 1.00 | 7.89 | C |
| ATOM | 337 | CA | TYR | A | 341 | -9.315 | 45.951 | 96.821 | 1.00 | 5.12 | C |
| ATOM | 338 | CA | SER | A | 342 | -6.670 | 45.736 | 94.210 | 1.00 | 8.33 | C |
| ATOM | 339 | CA | VAL | A | 343 | -3.270 | 46.457 | 95.522 | 1.00 | 13.73 | C |
| ATOM | 340 | CA | VAL | A | 344 | -3.012 | 49.349 | 93.078 | 1.00 | 8.71 | C |
| ATOM | 341 | CA | LEU | A | 345 | -6.234 | 50.676 | 94.324 | 1.00 | 9.62 | C |
| ATOM | 342 | CA | LEU | A | 346 | -4.653 | 50.535 | 97.862 | 1.00 | 9.36 | C |
| ATOM | 343 | CA | LEU | A | 347 | -1.694 | 52.380 | 96.840 | 1.00 | 13.62 | C |
| ATOM | 344 | CA | ARG | A | 348 | -3.895 | 54.931 | 95.078 | 1.00 | 16.63 | C |
| ATOM | 345 | CA | LEU | A | 349 | -5.639 | 55.695 | 98.348 | 1.00 | 15.66 | C |
| ATOM | 346 | CA | ALA | A | 350 | -2.350 | 55.899 | 100.215 | 1.00 | 18.12 | C |
| ATOM | 347 | CA | LYS | A | 351 | -1.267 | 58.461 | 97.626 | 1.00 | 21.77 | C |
| ATOM | 348 | CA | THR | A | 352 | -4.485 | 60.421 | 97.846 | 1.00 | 20.76 | C |
| ATOM | 349 | CA | TYR | A | 353 | -4.053 | 60.412 | 101.640 | 1.00 | 21.67 | C |
| ATOM | 350 | CA | GLU | A | 354 | -0.409 | 61.473 | 101.570 | 1.00 | 21.01 | C |
| ATOM | 351 | CA | THR | A | 355 | -1.034 | 64.491 | 99.396 | 1.00 | 27.79 | C |
| ATOM | 352 | CA | THR | A | 356 | -4.083 | 65.218 | 101.488 | 1.00 | 31.35 | C |
| ATOM | 353 | CA | LEU | A | 357 | -1.897 | 65.656 | 104.552 | 1.00 | 33.16 | C |
| ATOM | 354 | CA | GLU | A | 358 | 0.657 | 67.753 | 102.705 | 1.00 | 34.90 | C |
| ATOM | 355 | CA | LYS | A | 359 | -2.103 | 70.254 | 101.926 | 1.00 | 35.40 | C |
| ATOM | 356 | CA | CYS | A | 360 | -3.995 | 70.055 | 105.214 | 1.00 | 44.38 | C |
| ATOM | 357 | CA | CYS | A | 361 | -1.139 | 69.726 | 107.710 | 1.00 | 57.67 | C |
| ATOM | 358 | CA | ALA | A | 362 | -0.246 | 73.367 | 107.151 | 1.00 | 67.54 | C |
| ATOM | 359 | CA | ALA | A | 363 | -3.678 | 74.978 | 106.789 | 1.00 | 71.93 | C |
| ATOM | 360 | CA | ALA | A | 364 | -4.740 | 77.023 | 109.812 | 1.00 | 75.79 | C |
| ATOM | 361 | CA | ASP | A | 365 | -7.137 | 74.420 | 111.151 | 1.00 | 78.79 | C |
| ATOM | 362 | CA | PRO | A | 366 | -6.085 | 70.852 | 110.122 | 1.00 | 75.40 | C |
| ATOM | 363 | CA | HIS | A | 367 | -9.059 | 68.946 | 111.575 | 1.00 | 75.73 | C |
| ATOM | 364 | CA | GLU | A | 368 | -11.668 | 70.492 | 109.334 | 1.00 | 71.02 | C |
| ATOM | 365 | CA | CYS | A | 369 | -10.072 | 69.911 | 105.908 | 1.00 | 63.73 | C |
| ATOM | 366 | CA | TYR | A | 370 | -8.902 | 66.299 | 106.145 | 1.00 | 55.35 | C |
| ATOM | 367 | CA | ALA | A | 371 | -12.176 | 65.410 | 107.848 | 1.00 | 49.65 | C |
| ATOM | 368 | CA | LYS | A | 372 | -13.333 | 64.643 | 104.291 | 1.00 | 53.30 | C |

Figure 18 (continued)

| | | | | | | | | | | | |
|---|---|---|---|---|---|---|---|---|---|---|---|
| ATOM | 369 | CA | VAL | A | 373 | -10.600 | 62.165 | 103.135 | 1.00 | 44.72 | C |
| ATOM | 370 | CA | PHE | A | 374 | -12.730 | 58.967 | 102.365 | 1.00 | 40.03 | C |
| ATOM | 371 | CA | ASP | A | 375 | -15.168 | 61.043 | 100.984 | 1.00 | 40.74 | C |
| ATOM | 372 | CA | GLU | A | 376 | -12.384 | 61.392 | 98.401 | 1.00 | 34.94 | C |
| ATOM | 373 | CA | PHE | A | 377 | -11.585 | 57.672 | 98.491 | 1.00 | 37.79 | C |
| ATOM | 374 | CA | LYS | A | 378 | -15.094 | 56.949 | 97.207 | 1.00 | 23.23 | C |
| ATOM | 375 | CA | PRO | A | 379 | -14.908 | 57.796 | 93.458 | 1.00 | 16.76 | C |
| ATOM | 376 | CA | LEU | A | 380 | -11.614 | 56.064 | 93.425 | 1.00 | 12.04 | C |
| ATOM | 377 | CA | VAL | A | 381 | -13.287 | 52.947 | 94.603 | 1.00 | 13.00 | C |
| ATOM | 378 | CA | GLU | A | 382 | -16.246 | 52.973 | 92.160 | 1.00 | 28.23 | C |
| ATOM | 379 | CA | GLU | A | 383 | -14.522 | 53.249 | 89.793 | 1.00 | 32.93 | C |
| ATOM | 380 | CA | PRO | A | 384 | -12.542 | 49.990 | 89.067 | 1.00 | 27.11 | C |
| ATOM | 381 | CA | GLN | A | 385 | -15.528 | 48.023 | 90.435 | 1.00 | 31.58 | C |
| ATOM | 382 | CA | ASN | A | 386 | -17.544 | 49.360 | 87.617 | 1.00 | 39.02 | C |
| ATOM | 383 | CA | LEU | A | 387 | -14.944 | 48.551 | 84.971 | 1.00 | 40.36 | C |
| ATOM | 384 | CA | ILE | A | 388 | -14.451 | 44.951 | 86.047 | 1.00 | 39.64 | C |
| ATOM | 385 | CA | LYS | A | 389 | -18.220 | 44.689 | 86.157 | 1.00 | 40.00 | C |
| ATOM | 386 | CA | GLN | A | 390 | -18.486 | 46.003 | 82.583 | 1.00 | 39.50 | C |
| ATOM | 387 | CA | ASN | A | 391 | -15.657 | 43.896 | 81.113 | 1.00 | 39.86 | C |
| ATOM | 388 | CA | CYS | A | 392 | -16.931 | 40.729 | 82.809 | 1.00 | 41.91 | C |
| ATOM | 389 | CA | GLU | A | 393 | -20.370 | 41.010 | 81.244 | 1.00 | 47.90 | C |
| ATOM | 390 | CA | LEU | A | 394 | -18.923 | 41.605 | 77.816 | 1.00 | 45.15 | C |
| ATOM | 391 | CA | PHE | A | 395 | -16.899 | 38.438 | 78.489 | 1.00 | 46.69 | C |
| ATOM | 392 | CA | GLU | A | 396 | -19.863 | 36.130 | 79.301 | 1.00 | 57.07 | C |
| ATOM | 393 | CA | GLN | A | 397 | -21.466 | 37.337 | 76.062 | 1.00 | 55.52 | C |
| ATOM | 394 | CA | LEU | A | 398 | -18.629 | 37.205 | 73.522 | 1.00 | 40.26 | C |
| ATOM | 395 | CA | GLY | A | 399 | -16.563 | 34.415 | 74.979 | 1.00 | 34.80 | C |
| ATOM | 396 | CA | GLU | A | 400 | -12.764 | 34.645 | 75.281 | 1.00 | 30.63 | C |
| ATOM | 397 | CA | TYR | A | 401 | -11.546 | 34.695 | 71.671 | 1.00 | 32.33 | C |
| ATOM | 398 | CA | LYS | A | 402 | -14.127 | 37.267 | 70.615 | 1.00 | 32.27 | C |
| ATOM | 399 | CA | PHE | A | 403 | -13.548 | 39.241 | 73.824 | 1.00 | 24.42 | C |
| ATOM | 400 | CA | GLN | A | 404 | -9.873 | 39.533 | 72.937 | 1.00 | 24.17 | C |
| ATOM | 401 | CA | ASN | A | 405 | -10.982 | 40.656 | 69.493 | 1.00 | 21.32 | C |
| ATOM | 402 | CA | ALA | A | 406 | -13.014 | 43.427 | 71.062 | 1.00 | 22.24 | C |
| ATOM | 403 | CA | LEU | A | 407 | -10.064 | 44.439 | 73.222 | 1.00 | 23.27 | C |
| ATOM | 404 | CA | LEU | A | 408 | -7.752 | 44.298 | 70.210 | 1.00 | 25.77 | C |
| ATOM | 405 | CA | VAL | A | 409 | -9.899 | 46.790 | 68.311 | 1.00 | 26.63 | C |
| ATOM | 406 | CA | ARG | A | 410 | -10.372 | 48.822 | 71.454 | 1.00 | 28.99 | C |
| ATOM | 407 | CA | TYR | A | 411 | -6.629 | 48.996 | 72.202 | 1.00 | 16.19 | C |
| ATOM | 408 | CA | THR | A | 412 | -5.608 | 49.209 | 68.528 | 1.00 | 13.74 | C |
| ATOM | 409 | CA | LYS | A | 413 | -7.863 | 52.266 | 68.081 | 1.00 | 17.39 | C |
| ATOM | 410 | CA | LYS | A | 414 | -6.399 | 53.640 | 71.260 | 1.00 | 17.94 | C |
| ATOM | 411 | CA | VAL | A | 415 | -2.698 | 53.109 | 70.517 | 1.00 | 10.83 | C |
| ATOM | 412 | CA | PRO | A | 416 | -2.306 | 52.616 | 66.673 | 1.00 | 12.75 | C |
| ATOM | 413 | CA | GLN | A | 417 | 1.299 | 53.624 | 66.607 | 1.00 | 17.16 | C |
| ATOM | 414 | CA | VAL | A | 418 | 2.179 | 50.285 | 68.275 | 1.00 | 20.69 | C |

Figure 18 (continued)

| | | | | | | | | | | | |
|---|---|---|---|---|---|---|---|---|---|---|---|
| ATOM | 415 | CA | SER | A | 419 | 3.799 | 47.267 | 66.637 | 1.00 | 17.45 | C |
| ATOM | 416 | CA | THR | A | 420 | 1.236 | 44.667 | 65.577 | 1.00 | 11.09 | C |
| ATOM | 417 | CA | PRO | A | 421 | 3.048 | 41.677 | 67.246 | 1.00 | 7.52 | C |
| ATOM | 418 | CA | THR | A | 422 | 2.549 | 43.616 | 70.415 | 1.00 | 8.44 | C |
| ATOM | 419 | CA | LEU | A | 423 | -1.047 | 44.689 | 70.041 | 1.00 | 7.02 | C |
| ATOM | 420 | CA | VAL | A | 424 | -1.832 | 41.019 | 69.255 | 1.00 | 8.42 | C |
| ATOM | 421 | CA | GLU | A | 425 | 0.143 | 39.741 | 72.264 | 1.00 | 17.29 | C |
| ATOM | 422 | CA | VAL | A | 426 | -0.917 | 42.278 | 74.903 | 1.00 | 10.81 | C |
| ATOM | 423 | CA | SER | A | 427 | -4.578 | 42.283 | 73.851 | 1.00 | 10.63 | C |
| ATOM | 424 | CA | ARG | A | 428 | -4.829 | 38.469 | 73.918 | 1.00 | 7.51 | C |
| ATOM | 425 | CA | ASN | A | 429 | -3.393 | 38.656 | 77.415 | 1.00 | 10.79 | C |
| ATOM | 426 | CA | LEU | A | 430 | -5.625 | 41.594 | 78.411 | 1.00 | 18.51 | C |
| ATOM | 427 | CA | GLY | A | 431 | -8.428 | 39.412 | 77.102 | 1.00 | 17.41 | C |
| ATOM | 428 | CA | LYS | A | 432 | -7.443 | 36.554 | 79.371 | 1.00 | 12.02 | C |
| ATOM | 429 | CA | VAL | A | 433 | -8.562 | 38.636 | 82.391 | 1.00 | 19.36 | C |
| ATOM | 430 | CA | GLY | A | 434 | -12.087 | 37.376 | 81.760 | 1.00 | 21.28 | C |
| ATOM | 431 | CA | SER | A | 435 | -11.447 | 33.665 | 82.256 | 1.00 | 23.34 | C |
| ATOM | 432 | CA | LYS | A | 436 | -9.225 | 34.389 | 85.267 | 1.00 | 27.99 | C |
| ATOM | 433 | CA | CYS | A | 437 | -11.448 | 36.574 | 87.355 | 1.00 | 34.54 | C |
| ATOM | 434 | CA | CYS | A | 438 | -15.074 | 36.741 | 86.114 | 1.00 | 40.73 | C |
| ATOM | 435 | CA | LYS | A | 439 | -15.415 | 33.254 | 87.708 | 1.00 | 46.38 | C |
| ATOM | 436 | CA | HIS | A | 440 | -15.181 | 34.893 | 91.179 | 1.00 | 47.02 | C |
| ATOM | 437 | CA | PRO | A | 441 | -17.721 | 36.460 | 93.543 | 1.00 | 47.86 | C |
| ATOM | 438 | CA | GLU | A | 442 | -18.054 | 40.236 | 93.061 | 1.00 | 46.30 | C |
| ATOM | 439 | CA | ALA | A | 443 | -15.679 | 40.386 | 96.070 | 1.00 | 39.59 | C |
| ATOM | 440 | CA | LYS | A | 444 | -12.562 | 38.635 | 94.861 | 1.00 | 30.04 | C |
| ATOM | 441 | CA | ARG | A | 445 | -12.785 | 40.268 | 91.208 | 1.00 | 35.29 | C |
| ATOM | 442 | CA | MET | A | 446 | -11.006 | 43.550 | 91.803 | 1.00 | 28.33 | C |
| ATOM | 443 | CA | PRO | A | 447 | -7.803 | 42.184 | 93.248 | 1.00 | 25.09 | C |
| ATOM | 444 | CA | CYS | A | 448 | -7.612 | 39.440 | 90.649 | 1.00 | 22.18 | C |
| ATOM | 445 | CA | ALA | A | 449 | -8.647 | 41.774 | 87.900 | 1.00 | 19.16 | C |
| ATOM | 446 | CA | GLU | A | 450 | -6.954 | 45.088 | 88.182 | 1.00 | 18.07 | C |
| ATOM | 447 | CA | ASP | A | 451 | -3.694 | 43.557 | 89.289 | 1.00 | 9.60 | C |
| ATOM | 448 | CA | TYR | A | 452 | -3.827 | 41.157 | 86.336 | 1.00 | 5.78 | C |
| ATOM | 449 | CA | LEU | A | 453 | -4.297 | 44.204 | 84.179 | 1.00 | 12.83 | C |
| ATOM | 450 | CA | SER | A | 454 | -1.326 | 45.997 | 85.594 | 1.00 | 15.11 | C |
| ATOM | 451 | CA | VAL | A | 455 | 0.979 | 43.014 | 84.897 | 1.00 | 6.34 | C |
| ATOM | 452 | CA | VAL | A | 456 | -0.360 | 42.995 | 81.325 | 1.00 | 4.73 | C |
| ATOM | 453 | CA | LEU | A | 457 | 0.107 | 46.695 | 80.853 | 1.00 | 2.10 | C |
| ATOM | 454 | CA | ASN | A | 458 | 3.638 | 46.712 | 82.221 | 1.00 | 2.23 | C |
| ATOM | 455 | CA | GLN | A | 459 | 4.264 | 44.144 | 79.507 | 1.00 | 13.33 | C |
| ATOM | 456 | CA | LEU | A | 460 | 3.337 | 46.709 | 76.813 | 1.00 | 13.02 | C |
| ATOM | 457 | CA | CYS | A | 461 | 5.291 | 49.456 | 78.468 | 1.00 | 16.48 | C |
| ATOM | 458 | CA | VAL | A | 462 | 8.495 | 47.398 | 78.227 | 1.00 | 15.47 | C |
| ATOM | 459 | CA | LEU | A | 463 | 7.954 | 46.100 | 74.709 | 1.00 | 15.89 | C |
| ATOM | 460 | CA | HIS | A | 464 | 7.116 | 49.641 | 73.589 | 1.00 | 16.68 | C |

Figure 18 (continued)

| | | | | | | | | | | | |
|---|---|---|---|---|---|---|---|---|---|---|---|
| ATOM | 461 | CA | GLU | A | 465 | 9.924 | 51.261 | 75.507 | 1.00 | 27.38 | C |
| ATOM | 462 | CA | LYS | A | 466 | 12.372 | 49.253 | 73.391 | 1.00 | 32.43 | C |
| ATOM | 463 | CA | THR | A | 467 | 11.185 | 50.896 | 70.190 | 1.00 | 32.06 | C |
| ATOM | 464 | CA | PRO | A | 468 | 9.040 | 53.899 | 71.299 | 1.00 | 27.79 | C |
| ATOM | 465 | CA | VAL | A | 469 | 6.401 | 54.872 | 68.733 | 1.00 | 25.60 | C |
| ATOM | 466 | CA | SER | A | 470 | 3.407 | 56.412 | 70.529 | 1.00 | 28.85 | C |
| ATOM | 467 | CA | ASP | A | 471 | 3.686 | 59.177 | 73.085 | 1.00 | 37.18 | C |
| ATOM | 468 | CA | ARG | A | 472 | 0.462 | 58.371 | 74.917 | 1.00 | 36.39 | C |
| ATOM | 469 | CA | VAL | A | 473 | 1.928 | 54.963 | 75.690 | 1.00 | 25.09 | C |
| ATOM | 470 | CA | THR | A | 474 | 5.100 | 56.476 | 77.007 | 1.00 | 23.53 | C |
| ATOM | 471 | CA | LYS | A | 475 | 3.041 | 58.993 | 78.908 | 1.00 | 20.47 | C |
| ATOM | 472 | CA | CYS | A | 476 | 0.696 | 56.508 | 80.618 | 1.00 | 11.66 | C |
| ATOM | 473 | CA | CYS | A | 477 | 3.693 | 54.223 | 81.396 | 1.00 | 14.72 | C |
| ATOM | 474 | CA | THR | A | 478 | 6.121 | 56.874 | 82.759 | 1.00 | 17.18 | C |
| ATOM | 475 | CA | GLU | A | 479 | 3.675 | 59.244 | 84.540 | 1.00 | 25.98 | C |
| ATOM | 476 | CA | SER | A | 480 | 3.084 | 56.992 | 87.623 | 1.00 | 25.89 | C |
| ATOM | 477 | CA | LEU | A | 481 | 3.090 | 53.204 | 88.043 | 1.00 | 18.57 | C |
| ATOM | 478 | CA | VAL | A | 482 | -0.012 | 53.152 | 90.167 | 1.00 | 19.96 | C |
| ATOM | 479 | CA | ASN | A | 483 | -2.188 | 54.961 | 87.625 | 1.00 | 20.96 | C |
| ATOM | 480 | CA | ARG | A | 484 | -1.467 | 53.021 | 84.453 | 1.00 | 19.43 | C |
| ATOM | 481 | CA | ARG | A | 485 | -4.675 | 51.088 | 84.094 | 1.00 | 13.76 | C |
| ATOM | 482 | CA | PRO | A | 486 | -6.743 | 54.179 | 84.935 | 1.00 | 13.05 | C |
| ATOM | 483 | CA | CYS | A | 487 | -4.517 | 56.009 | 82.350 | 1.00 | 16.33 | C |
| ATOM | 484 | CA | PHE | A | 488 | -4.988 | 53.549 | 79.512 | 1.00 | 20.72 | C |
| ATOM | 485 | CA | SER | A | 489 | -8.631 | 53.023 | 80.391 | 1.00 | 26.84 | C |
| ATOM | 486 | CA | ALA | A | 490 | -9.036 | 56.787 | 80.054 | 1.00 | 29.73 | C |
| ATOM | 487 | CA | LEU | A | 491 | -7.370 | 57.253 | 76.637 | 1.00 | 36.13 | C |
| ATOM | 488 | CA | GLU | A | 492 | -9.672 | 57.425 | 73.607 | 1.00 | 48.73 | C |
| ATOM | 489 | CA | VAL | A | 493 | -9.386 | 56.892 | 69.810 | 1.00 | 54.67 | C |
| ATOM | 490 | CA | ASP | A | 494 | -6.277 | 58.730 | 68.551 | 1.00 | 58.89 | C |
| ATOM | 491 | CA | GLU | A | 495 | -7.557 | 61.207 | 65.997 | 1.00 | 66.27 | C |
| ATOM | 492 | CA | THR | A | 496 | -3.974 | 62.224 | 65.119 | 1.00 | 64.51 | C |
| ATOM | 493 | CA | TYR | A | 497 | -3.861 | 58.828 | 63.308 | 1.00 | 65.80 | C |
| ATOM | 494 | CA | VAL | A | 498 | -2.271 | 58.754 | 59.864 | 1.00 | 66.05 | C |
| ATOM | 495 | CA | PRO | A | 499 | -3.373 | 55.296 | 58.422 | 1.00 | 69.68 | C |
| ATOM | 496 | CA | LYS | A | 500 | -1.627 | 53.170 | 55.746 | 1.00 | 78.46 | C |
| ATOM | 497 | CA | GLU | A | 501 | -3.945 | 52.654 | 52.767 | 1.00 | 90.73 | C |
| ATOM | 498 | CA | PHE | A | 502 | -3.796 | 48.913 | 52.160 | 1.00 | 94.08 | C |
| ATOM | 499 | CA | ASN | A | 503 | -0.942 | 46.324 | 51.785 | 1.00 | 100.11 | C |
| ATOM | 500 | CA | ALA | A | 504 | -1.231 | 44.029 | 48.804 | 1.00 | 99.17 | C |
| ATOM | 501 | CA | GLU | A | 505 | 0.523 | 41.118 | 50.588 | 1.00 | 96.09 | C |
| ATOM | 502 | CA | THR | A | 506 | 0.068 | 41.226 | 54.363 | 1.00 | 86.67 | C |
| ATOM | 503 | CA | PHE | A | 507 | -3.489 | 39.891 | 53.908 | 1.00 | 79.82 | C |
| ATOM | 504 | CA | THR | A | 508 | -2.510 | 36.857 | 51.848 | 1.00 | 76.69 | C |
| ATOM | 505 | CA | PHE | A | 509 | -2.869 | 33.843 | 54.070 | 1.00 | 70.60 | C |
| ATOM | 506 | CA | HIS | A | 510 | -0.978 | 30.816 | 52.942 | 1.00 | 68.07 | C |

Figure 18 (continued)

| | | | | | | | | | | | |
|---|---|---|---|---|---|---|---|---|---|---|---|
| ATOM | 507 | CA | ALA | A | 511 | -1.984 | 27.157 | 52.815 | 1.00 | 59.96 | C |
| ATOM | 508 | CA | ASP | A | 512 | 0.476 | 26.200 | 55.578 | 1.00 | 49.08 | C |
| ATOM | 509 | CA | ILE | A | 513 | -1.856 | 28.044 | 57.829 | 1.00 | 38.54 | C |
| ATOM | 510 | CA | CYS | A | 514 | -3.799 | 24.760 | 57.804 | 1.00 | 32.94 | C |
| ATOM | 511 | CA | THR | A | 515 | -1.028 | 22.886 | 59.584 | 1.00 | 29.60 | C |
| ATOM | 512 | CA | LEU | A | 516 | -0.527 | 25.287 | 62.470 | 1.00 | 34.98 | C |
| ATOM | 513 | CA | SER | A | 517 | -2.502 | 25.005 | 65.759 | 1.00 | 42.68 | C |
| ATOM | 514 | CA | GLU | A | 518 | -5.921 | 26.599 | 66.323 | 1.00 | 48.62 | C |
| ATOM | 515 | CA | LYS | A | 519 | -4.149 | 28.945 | 68.820 | 1.00 | 48.81 | C |
| ATOM | 516 | CA | GLU | A | 520 | -1.777 | 30.355 | 66.221 | 1.00 | 35.12 | C |
| ATOM | 517 | CA | ARG | A | 521 | -4.464 | 30.378 | 63.606 | 1.00 | 24.46 | C |
| ATOM | 518 | CA | GLN | A | 522 | -6.414 | 32.791 | 65.832 | 1.00 | 22.73 | C |
| ATOM | 519 | CA | ILE | A | 523 | -3.049 | 34.815 | 66.202 | 1.00 | 23.38 | C |
| ATOM | 520 | CA | LYS | A | 524 | -2.998 | 35.017 | 62.425 | 1.00 | 23.51 | C |
| ATOM | 521 | CA | LYS | A | 525 | -6.633 | 36.075 | 62.080 | 1.00 | 19.92 | C |
| ATOM | 522 | CA | GLN | A | 526 | -6.271 | 38.544 | 64.962 | 1.00 | 8.29 | C |
| ATOM | 523 | CA | THR | A | 527 | -3.094 | 40.016 | 63.491 | 1.00 | 8.42 | C |
| ATOM | 524 | CA | ALA | A | 528 | -5.002 | 40.938 | 60.333 | 1.00 | 21.61 | C |
| ATOM | 525 | CA | LEU | A | 529 | -7.747 | 42.321 | 62.424 | 1.00 | 16.04 | C |
| ATOM | 526 | CA | VAL | A | 530 | -5.167 | 44.598 | 63.845 | 1.00 | 21.03 | C |
| ATOM | 527 | CA | GLU | A | 531 | -4.065 | 45.522 | 60.373 | 1.00 | 29.68 | C |
| ATOM | 528 | CA | LEU | A | 532 | -7.656 | 46.238 | 59.363 | 1.00 | 34.63 | C |
| ATOM | 529 | CA | VAL | A | 533 | -8.115 | 48.762 | 62.096 | 1.00 | 39.02 | C |
| ATOM | 530 | CA | LYS | A | 534 | -4.824 | 50.366 | 61.142 | 1.00 | 44.01 | C |
| ATOM | 531 | CA | HIS | A | 535 | -6.337 | 51.356 | 57.762 | 1.00 | 60.90 | C |
| ATOM | 532 | CA | LYS | A | 536 | -9.977 | 52.064 | 58.629 | 1.00 | 68.47 | C |
| ATOM | 533 | CA | PRO | A | 537 | -10.157 | 53.294 | 62.227 | 1.00 | 78.14 | C |
| ATOM | 534 | CA | LYS | A | 538 | -12.601 | 56.151 | 61.678 | 1.00 | 91.61 | C |
| ATOM | 535 | CA | ALA | A | 539 | -15.742 | 54.099 | 61.066 | 1.00 | 98.07 | C |
| ATOM | 536 | CA | THR | A | 540 | -15.634 | 50.630 | 62.508 | 1.00 | 94.45 | C |
| ATOM | 537 | CA | LYS | A | 541 | -18.909 | 49.476 | 63.916 | 1.00 | 96.85 | C |
| ATOM | 538 | CA | GLU | A | 542 | -20.085 | 45.862 | 64.214 | 1.00 | 95.84 | C |
| ATOM | 539 | CA | GLN | A | 543 | -19.200 | 45.824 | 60.505 | 1.00 | 90.40 | C |
| ATOM | 540 | CA | LEU | A | 544 | -15.666 | 44.981 | 61.602 | 1.00 | 88.33 | C |
| ATOM | 541 | CA | LYS | A | 545 | -16.783 | 41.983 | 63.690 | 1.00 | 89.42 | C |
| ATOM | 542 | CA | ALA | A | 546 | -18.420 | 40.915 | 60.377 | 1.00 | 87.01 | C |
| ATOM | 543 | CA | VAL | A | 547 | -15.398 | 41.296 | 58.048 | 1.00 | 82.82 | C |
| ATOM | 544 | CA | MET | A | 548 | -13.362 | 39.207 | 60.515 | 1.00 | 80.21 | C |
| ATOM | 545 | CA | ASP | A | 549 | -15.819 | 36.295 | 60.314 | 1.00 | 77.80 | C |
| ATOM | 546 | CA | ASP | A | 550 | -15.213 | 36.030 | 56.941 | 1.00 | 72.42 | C |
| ATOM | 547 | CA | PHE | A | 551 | -11.522 | 35.266 | 57.057 | 1.00 | 66.15 | C |
| ATOM | 548 | CA | ALA | A | 552 | -12.359 | 32.529 | 59.547 | 1.00 | 61.62 | C |
| ATOM | 549 | CA | ALA | A | 553 | -14.698 | 31.098 | 56.858 | 1.00 | 57.09 | C |
| ATOM | 550 | CA | PHE | A | 554 | -12.097 | 31.700 | 54.209 | 1.00 | 56.82 | C |
| ATOM | 551 | CA | VAL | A | 555 | -9.561 | 29.647 | 56.203 | 1.00 | 59.24 | C |
| ATOM | 552 | CA | GLU | A | 556 | -11.919 | 26.838 | 57.278 | 1.00 | 62.29 | C |

Figure 18 (continued)

| | | | | | | | | | | | |
|---|---|---|---|---|---|---|---|---|---|---|---|
| ATOM | 553 | CA | LYS | A | 557 | -13.102 | 26.721 | 53.630 | 1.00 | 65.39 | C |
| ATOM | 554 | CA | CYS | A | 558 | -9.817 | 26.914 | 51.722 | 1.00 | 66.62 | C |
| ATOM | 555 | CA | CYS | A | 559 | -8.032 | 24.588 | 54.182 | 1.00 | 64.31 | C |
| ATOM | 556 | CA | LYS | A | 560 | -10.267 | 21.846 | 52.745 | 1.00 | 77.98 | C |
| ATOM | 557 | CA | ALA | A | 561 | -10.754 | 22.645 | 49.035 | 1.00 | 86.74 | C |
| ATOM | 558 | CA | ASP | A | 562 | -8.500 | 19.776 | 47.816 | 1.00 | 97.78 | C |
| ATOM | 559 | CA | ASP | A | 563 | -6.974 | 22.599 | 45.818 | 1.00 | 100.66 | C |
| ATOM | 560 | CA | LYS | A | 564 | -3.256 | 22.933 | 44.669 | 1.00 | 100.39 | C |
| ATOM | 561 | CA | GLU | A | 565 | -2.830 | 25.938 | 47.047 | 1.00 | 92.61 | C |
| ATOM | 562 | CA | THR | A | 566 | -5.115 | 27.616 | 44.512 | 1.00 | 87.05 | C |
| ATOM | 563 | CA | CYS | A | 567 | -8.282 | 28.786 | 46.337 | 1.00 | 84.45 | C |
| ATOM | 564 | CA | PHE | A | 568 | -6.227 | 29.875 | 49.343 | 1.00 | 89.48 | C |
| ATOM | 565 | CA | ALA | A | 569 | -4.391 | 32.399 | 47.160 | 1.00 | 92.85 | C |
| ATOM | 566 | CA | GLU | A | 570 | -7.094 | 32.956 | 44.512 | 1.00 | 96.24 | C |
| ATOM | 567 | CA | GLU | A | 571 | -9.977 | 33.404 | 46.960 | 1.00 | 95.08 | C |
| ATOM | 568 | CA | GLY | A | 572 | -7.717 | 35.681 | 48.978 | 1.00 | 95.23 | C |
| ATOM | 569 | CA | LYS | A | 573 | -7.227 | 37.891 | 45.898 | 1.00 | 97.34 | C |
| ATOM | 570 | CA | LYS | A | 574 | -11.006 | 38.326 | 45.461 | 1.00 | 97.78 | C |
| ATOM | 571 | CA | LEU | A | 575 | -11.701 | 38.633 | 49.165 | 1.00 | 96.08 | C |
| ATOM | 572 | CA | VAL | A | 576 | -9.052 | 41.323 | 49.682 | 1.00 | 95.88 | C |
| ATOM | 573 | CA | ALA | A | 577 | -11.006 | 43.300 | 47.074 | 1.00 | 95.78 | C |
| ATOM | 574 | CA | ALA | A | 578 | -14.189 | 42.506 | 49.002 | 1.00 | 97.38 | C |
| ATOM | 575 | CA | SER | A | 579 | -12.792 | 43.855 | 52.277 | 1.00 | 102.29 | C |
| ATOM | 576 | CA | GLN | A | 580 | -11.279 | 46.969 | 50.612 | 1.00 | 104.26 | C |
| ATOM | 577 | CA | ALA | A | 581 | -14.648 | 47.830 | 49.043 | 1.00 | 106.22 | C |
| ATOM | 578 | CA | ALA | A | 582 | -16.594 | 47.399 | 52.298 | 1.00 | 107.63 | C |

END

Figure 19

| | | | | | | | | | | | |
|---|---|---|---|---|---|---|---|---|---|---|---|
| ATOM | 1 | CA | LEU | A | 5 | 16.033 | 37.869 | 60.258 | 1.00 | 31.92 | C |
| ATOM | 2 | CA | SER | A | 6 | 14.614 | 41.152 | 58.911 | 1.00 | 31.49 | C |
| ATOM | 3 | CA | LEU | A | 7 | 12.627 | 41.968 | 55.760 | 1.00 | 29.98 | C |
| ATOM | 4 | CA | LEU | A | 8 | 14.143 | 44.885 | 53.844 | 1.00 | 28.05 | C |
| ATOM | 5 | CA | TYR | A | 9 | 13.337 | 46.770 | 50.647 | 1.00 | 26.38 | C |
| ATOM | 6 | CA | HIS | A | 10 | 16.208 | 48.251 | 48.656 | 1.00 | 25.38 | C |
| ATOM | 7 | CA | LEU | A | 11 | 14.717 | 51.134 | 46.660 | 1.00 | 25.73 | C |
| ATOM | 8 | CA | THR | A | 12 | 16.582 | 53.176 | 44.048 | 1.00 | 26.43 | C |
| ATOM | 9 | CA | ALA | A | 13 | 15.481 | 56.033 | 41.786 | 1.00 | 26.61 | C |
| ATOM | 10 | CA | VAL | A | 14 | 17.513 | 57.893 | 39.155 | 1.00 | 26.84 | C |
| ATOM | 11 | CA | SER | A | 15 | 16.698 | 61.252 | 37.514 | 1.00 | 27.79 | C |
| ATOM | 12 | CA | SER | A | 16 | 18.529 | 60.512 | 34.244 | 1.00 | 28.29 | C |
| ATOM | 13 | CA | PRO | A | 17 | 18.224 | 56.789 | 33.513 | 1.00 | 28.36 | C |
| ATOM | 14 | CA | ALA | A | 18 | 20.126 | 55.473 | 30.497 | 1.00 | 28.48 | C |
| ATOM | 15 | CA | PRO | A | 19 | 17.810 | 54.439 | 27.618 | 1.00 | 28.54 | C |
| ATOM | 16 | CA | GLY | A | 20 | 16.447 | 50.918 | 28.218 | 1.00 | 27.15 | C |
| ATOM | 17 | CA | THR | A | 21 | 17.103 | 51.258 | 31.969 | 1.00 | 25.51 | C |
| ATOM | 18 | CA | PRO | A | 22 | 14.611 | 51.660 | 34.859 | 1.00 | 23.91 | C |
| ATOM | 19 | CA | ALA | A | 23 | 14.180 | 55.044 | 36.541 | 1.00 | 22.51 | C |
| ATOM | 20 | CA | PHE | A | 24 | 13.177 | 53.097 | 39.662 | 1.00 | 20.91 | C |
| ATOM | 21 | CA | TRP | A | 25 | 13.834 | 49.545 | 40.897 | 1.00 | 20.63 | C |
| ATOM | 22 | CA | VAL | A | 26 | 13.438 | 47.516 | 44.091 | 1.00 | 20.28 | C |
| ATOM | 23 | CA | SER | A | 27 | 14.907 | 44.324 | 45.461 | 1.00 | 20.98 | C |
| ATOM | 24 | CA | GLY | A | 28 | 13.265 | 42.668 | 48.480 | 1.00 | 21.54 | C |
| ATOM | 25 | CA | TRP | A | 29 | 15.339 | 40.802 | 51.048 | 1.00 | 22.54 | C |
| ATOM | 26 | CA | LEU | A | 30 | 14.670 | 38.229 | 53.748 | 1.00 | 23.08 | C |
| ATOM | 27 | CA | GLY | A | 31 | 17.917 | 38.393 | 55.701 | 1.00 | 23.03 | C |
| ATOM | 28 | CA | PRO | A | 32 | 20.708 | 37.996 | 53.180 | 1.00 | 22.95 | C |
| ATOM | 29 | CA | GLN | A | 33 | 18.453 | 36.301 | 50.665 | 1.00 | 22.57 | C |
| ATOM | 30 | CA | GLN | A | 34 | 16.546 | 38.011 | 47.814 | 1.00 | 21.13 | C |
| ATOM | 31 | CA | TYR | A | 35 | 12.650 | 37.158 | 47.504 | 1.00 | 20.78 | C |
| ATOM | 32 | CA | LEU | A | 36 | 11.549 | 40.036 | 45.448 | 1.00 | 20.53 | C |
| ATOM | 33 | CA | SER | A | 37 | 12.353 | 41.920 | 42.211 | 1.00 | 19.95 | C |
| ATOM | 34 | CA | TYR | A | 38 | 10.713 | 45.010 | 40.707 | 1.00 | 20.23 | C |
| ATOM | 35 | CA | ASN | A | 39 | 11.563 | 47.744 | 38.208 | 1.00 | 21.03 | C |
| ATOM | 36 | CA | SER | A | 40 | 9.734 | 50.561 | 36.381 | 1.00 | 22.50 | C |
| ATOM | 37 | CA | LEU | A | 41 | 10.476 | 48.950 | 32.985 | 1.00 | 24.67 | C |
| ATOM | 38 | CA | ASN | A | 42 | 8.059 | 46.076 | 33.741 | 1.00 | 25.53 | C |
| ATOM | 39 | CA | GLY | A | 43 | 6.032 | 47.460 | 36.676 | 1.00 | 24.88 | C |
| ATOM | 40 | CA | GLU | A | 44 | 5.464 | 44.115 | 38.371 | 1.00 | 25.01 | C |
| ATOM | 41 | CA | ALA | A | 45 | 6.852 | 43.610 | 41.584 | 1.00 | 23.58 | C |
| ATOM | 42 | CA | GLU | A | 46 | 8.024 | 39.024 | 41.091 | 1.00 | 22.66 | C |
| ATOM | 43 | CA | PRO | A | 47 | 9.576 | 36.246 | 43.267 | 1.00 | 22.81 | C |
| ATOM | 44 | CA | CYS | A | 48 | 13.202 | 35.273 | 43.163 | 1.00 | 23.55 | C |
| ATOM | 45 | CA | GLY | A | 49 | 15.065 | 31.911 | 43.492 | 1.00 | 23.05 | C |
| ATOM | 46 | CA | ALA | A | 50 | 13.321 | 29.064 | 45.636 | 1.00 | 23.17 | C |

Figure 19 (continued)

| | | | | | | | | | | | |
|---|---|---|---|---|---|---|---|---|---|---|---|
| ATOM | 47 | CA | TRP | A | 51 | 10.598 | 31.844 | 46.454 | 1.00 | 23.49 | C |
| ATOM | 48 | CA | VAL | A | 52 | 9.068 | 31.291 | 43.019 | 1.00 | 24.77 | C |
| ATOM | 49 | CA | TRP | A | 53 | 7.958 | 27.944 | 44.487 | 1.00 | 25.99 | C |
| ATOM | 50 | CA | GLU | A | 54 | 6.467 | 29.531 | 47.614 | 1.00 | 27.20 | C |
| ATOM | 51 | CA | ASN | A | 55 | 2.780 | 28.773 | 48.167 | 1.00 | 28.38 | C |
| ATOM | 52 | CA | GLN | A | 56 | 1.162 | 32.157 | 48.547 | 1.00 | 30.68 | C |
| ATOM | 53 | CA | VAL | A | 57 | -2.158 | 33.818 | 49.485 | 1.00 | 32.48 | C |
| ATOM | 54 | CA | SER | A | 58 | -2.967 | 34.446 | 45.776 | 1.00 | 33.03 | C |
| ATOM | 55 | CA | TRP | A | 59 | -3.255 | 38.226 | 46.277 | 1.00 | 32.64 | C |
| ATOM | 56 | CA | TYR | A | 60 | 0.265 | 38.581 | 47.706 | 1.00 | 30.00 | C |
| ATOM | 57 | CA | TRP | A | 61 | 2.276 | 39.553 | 44.631 | 1.00 | 28.58 | C |
| ATOM | 58 | CA | GLU | A | 62 | -0.365 | 41.972 | 43.322 | 1.00 | 28.41 | C |
| ATOM | 59 | CA | LYS | A | 63 | -0.319 | 43.672 | 46.752 | 1.00 | 26.60 | C |
| ATOM | 60 | CA | GLU | A | 64 | 3.482 | 43.894 | 46.676 | 1.00 | 25.46 | C |
| ATOM | 61 | CA | THR | A | 65 | 3.160 | 45.393 | 43.177 | 1.00 | 25.23 | C |
| ATOM | 62 | CA | THR | A | 66 | 0.542 | 48.014 | 44.098 | 1.00 | 25.17 | C |
| ATOM | 63 | CA | ASP | A | 67 | 2.588 | 49.057 | 47.156 | 1.00 | 24.46 | C |
| ATOM | 64 | CA | LEU | A | 68 | 5.809 | 49.344 | 45.119 | 1.00 | 24.18 | C |
| ATOM | 65 | CA | ARG | A | 69 | 3.911 | 51.222 | 42.383 | 1.00 | 24.95 | C |
| ATOM | 66 | CA | ILE | A | 70 | 2.856 | 53.779 | 45.008 | 1.00 | 26.40 | C |
| ATOM | 67 | CA | LYS | A | 71 | 6.476 | 54.105 | 46.198 | 1.00 | 27.28 | C |
| ATOM | 68 | CA | GLU | A | 72 | 7.493 | 54.547 | 42.538 | 1.00 | 28.21 | C |
| ATOM | 69 | CA | LYS | A | 73 | 5.359 | 57.678 | 41.988 | 1.00 | 29.60 | C |
| ATOM | 70 | CA | LEU | A | 74 | 6.597 | 59.109 | 45.308 | 1.00 | 30.43 | C |
| ATOM | 71 | CA | PHE | A | 75 | 10.291 | 58.572 | 44.504 | 1.00 | 30.42 | C |
| ATOM | 72 | CA | LEU | A | 76 | 10.010 | 60.068 | 41.002 | 1.00 | 31.27 | C |
| ATOM | 73 | CA | GLU | A | 77 | 8.022 | 62.933 | 42.550 | 1.00 | 31.70 | C |
| ATOM | 74 | CA | ALA | A | 78 | 10.931 | 63.729 | 44.893 | 1.00 | 30.69 | C |
| ATOM | 75 | CA | PHE | A | 79 | 13.076 | 64.806 | 41.932 | 1.00 | 30.15 | C |
| ATOM | 76 | CA | LYS | A | 80 | 10.627 | 67.601 | 41.050 | 1.00 | 30.58 | C |
| ATOM | 77 | CA | ALA | A | 81 | 11.322 | 69.240 | 44.425 | 1.00 | 30.28 | C |
| ATOM | 78 | CA | LEU | A | 82 | 15.048 | 69.464 | 43.595 | 1.00 | 29.61 | C |
| ATOM | 79 | CA | GLY | A | 83 | 16.537 | 72.523 | 41.892 | 1.00 | 29.50 | C |
| ATOM | 80 | CA | GLY | A | 84 | 20.201 | 71.639 | 41.418 | 1.00 | 29.00 | C |
| ATOM | 81 | CA | LYS | A | 85 | 22.123 | 70.783 | 38.260 | 1.00 | 29.13 | C |
| ATOM | 82 | CA | GLY | A | 86 | 21.661 | 67.040 | 38.855 | 1.00 | 28.55 | C |
| ATOM | 83 | CA | PRO | A | 87 | 21.602 | 64.166 | 38.036 | 1.00 | 28.04 | C |
| ATOM | 84 | CA | TYR | A | 88 | 20.307 | 62.589 | 41.270 | 1.00 | 27.98 | C |
| ATOM | 85 | CA | THR | A | 89 | 20.036 | 59.228 | 43.010 | 1.00 | 27.42 | C |
| ATOM | 86 | CA | LEU | A | 90 | 17.377 | 58.636 | 45.642 | 1.00 | 27.26 | C |
| ATOM | 87 | CA | GLN | A | 91 | 17.869 | 55.506 | 47.713 | 1.00 | 28.04 | C |
| ATOM | 88 | CA | GLY | A | 92 | 15.581 | 54.038 | 50.363 | 1.00 | 29.39 | C |
| ATOM | 89 | CA | LEU | A | 93 | 15.956 | 51.304 | 52.960 | 1.00 | 30.94 | C |
| ATOM | 90 | CA | LEU | A | 94 | 12.485 | 50.300 | 54.117 | 1.00 | 32.78 | C |
| ATOM | 91 | CA | GLY | A | 95 | 11.579 | 47.298 | 56.255 | 1.00 | 35.25 | C |
| ATOM | 92 | CA | CYS | A | 96 | 10.886 | 45.549 | 59.538 | 1.00 | 38.03 | C |

Figure 19 (continued)

| | | | | | | | | | | | |
|---|---|---|---|---|---|---|---|---|---|---|---|
| ATOM | 93 | CA | GLU | A | 97 | 11.899 | 42.757 | 61.914 | 1.00 | 40.69 | C |
| ATOM | 94 | CA | LEU | A | 98 | 10.020 | 40.778 | 64.566 | 1.00 | 42.26 | C |
| ATOM | 95 | CA | GLY | A | 99 | 10.683 | 41.632 | 68.164 | 1.00 | 43.85 | C |
| ATOM | 96 | CA | PRO | A | 100 | 10.335 | 39.955 | 71.516 | 1.00 | 45.18 | C |
| ATOM | 97 | CA | ASP | A | 101 | 6.727 | 40.683 | 72.555 | 1.00 | 45.77 | C |
| ATOM | 98 | CA | ASN | A | 102 | 5.001 | 40.239 | 69.160 | 1.00 | 45.69 | C |
| ATOM | 99 | CA | THR | A | 103 | 5.861 | 43.831 | 68.087 | 1.00 | 44.86 | C |
| ATOM | 100 | CA | SER | A | 104 | 8.040 | 44.701 | 65.082 | 1.00 | 42.69 | C |
| ATOM | 101 | CA | VAL | A | 105 | 10.963 | 47.097 | 64.660 | 1.00 | 40.53 | C |
| ATOM | 102 | CA | PRO | A | 106 | 10.892 | 49.396 | 61.589 | 1.00 | 38.57 | C |
| ATOM | 103 | CA | THR | A | 107 | 13.686 | 50.740 | 59.330 | 1.00 | 36.44 | C |
| ATOM | 104 | CA | ALA | A | 108 | 13.122 | 53.858 | 57.283 | 1.00 | 34.16 | C |
| ATOM | 105 | CA | LYS | A | 109 | 16.303 | 55.352 | 55.852 | 1.00 | 32.22 | C |
| ATOM | 106 | CA | PHE | A | 110 | 16.967 | 57.410 | 52.722 | 1.00 | 29.72 | C |
| ATOM | 107 | CA | ALA | A | 111 | 20.054 | 58.580 | 50.838 | 1.00 | 27.99 | C |
| ATOM | 108 | CA | LEU | A | 112 | 20.616 | 61.260 | 48.208 | 1.00 | 26.98 | C |
| ATOM | 109 | CA | ASN | A | 113 | 23.502 | 60.624 | 45.763 | 1.00 | 26.75 | C |
| ATOM | 110 | CA | GLY | A | 114 | 24.850 | 57.859 | 48.047 | 1.00 | 26.86 | C |
| ATOM | 111 | CA | GLU | A | 115 | 24.796 | 60.040 | 51.174 | 1.00 | 27.08 | C |
| ATOM | 112 | CA | GLU | A | 116 | 22.223 | 59.383 | 53.922 | 1.00 | 27.77 | C |
| ATOM | 113 | CA | PHE | A | 117 | 19.954 | 62.431 | 54.267 | 1.00 | 29.32 | C |
| ATOM | 114 | CA | MET | A | 118 | 16.403 | 61.458 | 55.309 | 1.00 | 31.21 | C |
| ATOM | 115 | CA | ASN | A | 119 | 14.511 | 59.133 | 57.612 | 1.00 | 33.28 | C |
| ATOM | 116 | CA | PHE | A | 120 | 10.872 | 58.432 | 58.393 | 1.00 | 34.77 | C |
| ATOM | 117 | CA | ASP | A | 121 | 9.808 | 59.403 | 61.955 | 1.00 | 37.59 | C |
| ATOM | 118 | CA | LEU | A | 122 | 7.395 | 56.752 | 62.795 | 1.00 | 39.35 | C |
| ATOM | 119 | CA | LYS | A | 123 | 6.578 | 58.471 | 66.120 | 1.00 | 40.71 | C |
| ATOM | 120 | CA | GLN | A | 124 | 5.049 | 61.546 | 64.471 | 1.00 | 41.87 | C |
| ATOM | 121 | CA | GLY | A | 125 | 4.651 | 60.260 | 60.877 | 1.00 | 42.37 | C |
| ATOM | 122 | CA | THR | A | 126 | 7.125 | 62.718 | 59.358 | 1.00 | 42.75 | C |
| ATOM | 123 | CA | TRP | A | 127 | 10.138 | 62.654 | 57.040 | 1.00 | 42.12 | C |
| ATOM | 124 | CA | GLY | A | 128 | 13.197 | 64.289 | 58.624 | 1.00 | 41.24 | C |
| ATOM | 125 | CA | GLY | A | 129 | 16.597 | 65.655 | 57.594 | 1.00 | 40.31 | C |
| ATOM | 126 | CA | ASP | A | 130 | 18.675 | 68.046 | 57.658 | 1.00 | 39.79 | C |
| ATOM | 127 | CA | TRP | A | 131 | 19.837 | 69.409 | 54.049 | 1.00 | 38.30 | C |
| ATOM | 128 | CA | PRO | A | 132 | 17.692 | 71.644 | 51.988 | 1.00 | 36.74 | C |
| ATOM | 129 | CA | GLU | A | 133 | 16.846 | 68.990 | 49.562 | 1.00 | 35.36 | C |
| ATOM | 130 | CA | ALA | A | 134 | 15.787 | 66.780 | 52.490 | 1.00 | 34.41 | C |
| ATOM | 131 | CA | LEU | A | 135 | 13.333 | 69.450 | 53.683 | 1.00 | 33.97 | C |
| ATOM | 132 | CA | ALA | A | 136 | 12.107 | 69.976 | 50.108 | 1.00 | 33.93 | C |
| ATOM | 133 | CA | ILE | A | 137 | 11.495 | 66.249 | 49.481 | 1.00 | 34.46 | C |
| ATOM | 134 | CA | SER | A | 138 | 9.915 | 65.897 | 52.946 | 1.00 | 36.24 | C |
| ATOM | 135 | CA | GLN | A | 139 | 7.490 | 68.767 | 52.250 | 1.00 | 38.47 | C |
| ATOM | 136 | CA | ARG | A | 140 | 6.433 | 67.387 | 48.857 | 1.00 | 39.77 | C |
| ATOM | 137 | CA | TRP | A | 141 | 5.901 | 63.935 | 50.374 | 1.00 | 41.30 | C |
| ATOM | 138 | CA | GLN | A | 142 | 3.841 | 65.465 | 53.201 | 1.00 | 43.36 | C |

Figure 19 (continued)

| | | | | | | | | | | | |
|---|---|---|---|---|---|---|---|---|---|---|---|
| ATOM | 139 | CA | GLN | A | 143 | 1.715 | 67.393 | 50.663 | 1.00 | 44.78 | C |
| ATOM | 140 | CA | GLN | A | 144 | 0.666 | 64.205 | 48.814 | 1.00 | 46.05 | C |
| ATOM | 141 | CA | ASP | A | 145 | -2.579 | 62.825 | 50.294 | 1.00 | 45.98 | C |
| ATOM | 142 | CA | LYS | A | 146 | -2.478 | 59.510 | 52.215 | 1.00 | 44.40 | C |
| ATOM | 143 | CA | ALA | A | 147 | 1.292 | 59.313 | 51.509 | 1.00 | 43.19 | C |
| ATOM | 144 | CA | ALA | A | 148 | 2.423 | 59.504 | 55.157 | 1.00 | 42.32 | C |
| ATOM | 145 | CA | ASN | A | 149 | -0.245 | 56.982 | 56.182 | 1.00 | 41.37 | C |
| ATOM | 146 | CA | LYS | A | 150 | 0.782 | 54.594 | 53.421 | 1.00 | 39.56 | C |
| ATOM | 147 | CA | GLU | A | 151 | 4.357 | 54.693 | 54.739 | 1.00 | 37.88 | C |
| ATOM | 148 | CA | LEU | A | 152 | 2.967 | 53.951 | 58.205 | 1.00 | 36.49 | C |
| ATOM | 149 | CA | THR | A | 153 | 0.730 | 51.093 | 56.987 | 1.00 | 35.78 | C |
| ATOM | 150 | CA | PHE | A | 154 | 3.671 | 49.813 | 54.922 | 1.00 | 35.61 | C |
| ATOM | 151 | CA | LEU | A | 155 | 6.129 | 49.542 | 57.836 | 1.00 | 36.57 | C |
| ATOM | 152 | CA | LEU | A | 156 | 3.897 | 48.721 | 60.829 | 1.00 | 37.78 | C |
| ATOM | 153 | CA | PHE | A | 157 | 1.126 | 46.573 | 59.321 | 1.00 | 38.42 | C |
| ATOM | 154 | CA | SER | A | 158 | 1.905 | 44.966 | 55.951 | 1.00 | 38.57 | C |
| ATOM | 155 | CA | CYS | A | 159 | 5.685 | 44.528 | 56.419 | 1.00 | 38.56 | C |
| ATOM | 156 | CA | PRO | A | 160 | 5.407 | 42.478 | 59.670 | 1.00 | 38.75 | C |
| ATOM | 157 | CA | HIS | A | 161 | 2.532 | 40.585 | 58.021 | 1.00 | 39.11 | C |
| ATOM | 158 | CA | ARG | A | 162 | 4.608 | 39.715 | 54.934 | 1.00 | 38.38 | C |
| ATOM | 159 | CA | LEU | A | 163 | 7.513 | 38.706 | 57.189 | 1.00 | 38.42 | C |
| ATOM | 160 | CA | ARG | A | 164 | 5.352 | 36.340 | 59.271 | 1.00 | 38.68 | C |
| ATOM | 161 | CA | GLU | A | 165 | 3.879 | 34.844 | 56.083 | 1.00 | 38.58 | C |
| ATOM | 162 | CA | HIS | A | 166 | 7.358 | 34.124 | 54.664 | 1.00 | 36.89 | C |
| ATOM | 163 | CA | LEU | A | 167 | 8.519 | 32.569 | 57.943 | 1.00 | 37.11 | C |
| ATOM | 164 | CA | GLU | A | 168 | 5.503 | 30.241 | 57.881 | 1.00 | 37.32 | C |
| ATOM | 165 | CA | ARG | A | 169 | 5.231 | 29.343 | 54.196 | 1.00 | 35.99 | C |
| ATOM | 166 | CA | GLY | A | 170 | 8.996 | 29.353 | 53.535 | 1.00 | 34.27 | C |
| ATOM | 167 | CA | ARG | A | 171 | 10.710 | 28.496 | 56.836 | 1.00 | 33.44 | C |
| ATOM | 168 | CA | GLY | A | 172 | 12.966 | 25.908 | 55.165 | 1.00 | 31.99 | C |
| ATOM | 169 | CA | ASN | A | 173 | 14.333 | 28.481 | 52.713 | 1.00 | 31.35 | C |
| ATOM | 170 | CA | LEU | A | 174 | 15.523 | 30.737 | 55.557 | 1.00 | 31.75 | C |
| ATOM | 171 | CA | GLU | A | 175 | 16.898 | 27.834 | 57.625 | 1.00 | 33.34 | C |
| ATOM | 172 | CA | TRP | A | 176 | 18.988 | 26.659 | 54.651 | 1.00 | 32.08 | C |
| ATOM | 173 | CA | LYS | A | 177 | 22.441 | 25.597 | 55.863 | 1.00 | 32.95 | C |
| ATOM | 174 | CA | GLU | A | 178 | 25.086 | 24.793 | 53.255 | 1.00 | 32.16 | C |
| ATOM | 175 | CA | PRO | A | 179 | 28.719 | 24.070 | 54.218 | 1.00 | 32.17 | C |
| ATOM | 176 | CA | PRO | A | 180 | 31.511 | 25.680 | 52.200 | 1.00 | 32.68 | C |
| ATOM | 177 | CA | SER | A | 181 | 33.832 | 23.698 | 49.961 | 1.00 | 34.10 | C |
| ATOM | 178 | CA | MET | A | 182 | 37.202 | 24.560 | 51.461 | 1.00 | 36.18 | C |
| ATOM | 179 | CA | ARG | A | 183 | 40.512 | 24.878 | 49.659 | 1.00 | 38.99 | C |
| ATOM | 180 | CA | LEU | A | 184 | 44.024 | 25.925 | 50.709 | 1.00 | 41.57 | C |
| ATOM | 181 | CA | LYS | A | 185 | 46.567 | 27.053 | 48.121 | 1.00 | 43.92 | C |
| ATOM | 182 | CA | ALA | A | 186 | 50.130 | 28.310 | 48.560 | 1.00 | 46.38 | C |
| ATOM | 183 | CA | ARG | A | 187 | 51.840 | 30.839 | 46.270 | 1.00 | 49.01 | C |
| ATOM | 184 | CA | PRO | A | 188 | 55.196 | 32.686 | 46.360 | 1.00 | 50.89 | C |

Figure 19 (continued)

| | | | | | | | | | | | |
|---|---|---|---|---|---|---|---|---|---|---|---|
| ATOM | 185 | CA | SER | A | 189 | 54.910 | 36.499 | 46.606 | 1.00 | 52.31 | C |
| ATOM | 186 | CA | SER | A | 190 | 58.024 | 38.554 | 47.461 | 1.00 | 53.29 | C |
| ATOM | 187 | CA | PRO | A | 191 | 60.950 | 36.030 | 47.500 | 1.00 | 53.73 | C |
| ATOM | 188 | CA | GLY | A | 192 | 61.565 | 34.789 | 51.056 | 1.00 | 53.38 | C |
| ATOM | 189 | CA | PHE | A | 193 | 57.810 | 35.001 | 51.679 | 1.00 | 52.26 | C |
| ATOM | 190 | CA | SER | A | 194 | 54.728 | 33.002 | 50.684 | 1.00 | 50.57 | C |
| ATOM | 191 | CA | VAL | A | 195 | 50.972 | 33.701 | 50.611 | 1.00 | 48.93 | C |
| ATOM | 192 | CA | LEU | A | 196 | 48.246 | 31.261 | 51.692 | 1.00 | 46.39 | C |
| ATOM | 193 | CA | THR | A | 197 | 44.704 | 31.523 | 50.345 | 1.00 | 44.33 | C |
| ATOM | 194 | CA | CYS | A | 198 | 41.954 | 29.864 | 52.363 | 1.00 | 42.30 | C |
| ATOM | 195 | CA | SER | A | 199 | 38.951 | 29.773 | 50.005 | 1.00 | 39.51 | C |
| ATOM | 196 | CA | ALA | A | 200 | 35.300 | 29.015 | 50.806 | 1.00 | 36.24 | C |
| ATOM | 197 | CA | PHE | A | 201 | 33.023 | 27.974 | 47.983 | 1.00 | 33.51 | C |
| ATOM | 198 | CA | SER | A | 202 | 29.189 | 27.898 | 47.920 | 1.00 | 31.90 | C |
| ATOM | 199 | CA | PHE | A | 203 | 27.947 | 28.410 | 51.484 | 1.00 | 30.54 | C |
| ATOM | 200 | CA | TYR | A | 204 | 24.865 | 29.720 | 53.277 | 1.00 | 30.71 | C |
| ATOM | 201 | CA | PRO | A | 205 | 24.252 | 31.637 | 55.483 | 1.00 | 32.07 | C |
| ATOM | 202 | CA | PRO | A | 206 | 27.039 | 34.201 | 54.726 | 1.00 | 33.50 | C |
| ATOM | 203 | CA | GLU | A | 207 | 27.972 | 34.281 | 58.435 | 1.00 | 36.27 | C |
| ATOM | 204 | CA | LEU | A | 208 | 31.418 | 32.697 | 58.335 | 1.00 | 38.49 | C |
| ATOM | 205 | CA | GLN | A | 209 | 34.796 | 32.880 | 60.078 | 1.00 | 40.37 | C |
| ATOM | 206 | CA | LEU | A | 210 | 38.165 | 31.883 | 58.626 | 1.00 | 42.43 | C |
| ATOM | 207 | CA | ARG | A | 211 | 41.001 | 31.598 | 61.134 | 1.00 | 44.71 | C |
| ATOM | 208 | CA | PHE | A | 212 | 44.611 | 30.658 | 60.418 | 1.00 | 46.67 | C |
| ATOM | 209 | CA | LEU | A | 213 | 46.514 | 28.571 | 62.967 | 1.00 | 48.09 | C |
| ATOM | 210 | CA | ARG | A | 214 | 50.283 | 28.556 | 63.399 | 1.00 | 49.13 | C |
| ATOM | 211 | CA | ASN | A | 215 | 51.347 | 25.127 | 64.691 | 1.00 | 50.48 | C |
| ATOM | 212 | CA | GLY | A | 216 | 47.972 | 24.753 | 66.452 | 1.00 | 51.60 | C |
| ATOM | 213 | CA | LEU | A | 217 | 48.272 | 28.117 | 68.214 | 1.00 | 53.12 | C |
| ATOM | 214 | CA | ALA | A | 218 | 46.439 | 31.235 | 66.975 | 1.00 | 53.94 | C |
| ATOM | 215 | CA | ALA | A | 219 | 47.558 | 33.170 | 63.893 | 1.00 | 53.79 | C |
| ATOM | 216 | CA | GLY | A | 220 | 44.374 | 35.230 | 63.490 | 1.00 | 53.56 | C |
| ATOM | 217 | CA | THR | A | 221 | 42.383 | 36.109 | 60.396 | 1.00 | 52.95 | C |
| ATOM | 218 | CA | GLY | A | 222 | 44.262 | 37.190 | 57.286 | 1.00 | 50.82 | C |
| ATOM | 219 | CA | GLN | A | 223 | 42.863 | 39.765 | 54.855 | 1.00 | 48.56 | C |
| ATOM | 220 | CA | GLY | A | 224 | 39.296 | 38.711 | 54.080 | 1.00 | 46.17 | C |
| ATOM | 221 | CA | ASP | A | 225 | 37.362 | 38.863 | 50.746 | 1.00 | 43.59 | C |
| ATOM | 222 | CA | PHE | A | 226 | 33.613 | 38.214 | 50.500 | 1.00 | 40.26 | C |
| ATOM | 223 | CA | GLY | A | 227 | 30.996 | 37.869 | 47.727 | 1.00 | 36.19 | C |
| ATOM | 224 | CA | PRO | A | 228 | 27.738 | 36.228 | 46.549 | 1.00 | 33.10 | C |
| ATOM | 225 | CA | ASN | A | 229 | 27.078 | 33.495 | 43.967 | 1.00 | 30.65 | C |
| ATOM | 226 | CA | SER | A | 230 | 24.279 | 33.387 | 41.356 | 1.00 | 29.58 | C |
| ATOM | 227 | CA | ASP | A | 231 | 22.133 | 30.967 | 43.406 | 1.00 | 28.97 | C |
| ATOM | 228 | CA | GLY | A | 232 | 22.180 | 33.242 | 46.462 | 1.00 | 27.59 | C |
| ATOM | 229 | CA | SER | A | 233 | 24.956 | 31.255 | 48.104 | 1.00 | 26.14 | C |
| ATOM | 230 | CA | PHE | A | 234 | 28.290 | 32.819 | 49.073 | 1.00 | 26.16 | C |

Figure 19 (continued)

| | | | | | | | | | | | |
|---|---|---|---|---|---|---|---|---|---|---|---|
| ATOM | 231 | CA | HIS | A | 235 | 32.043 | 32.882 | 48.553 | 1.00 | 29.49 | C |
| ATOM | 232 | CA | ALA | A | 236 | 34.915 | 34.035 | 50.736 | 1.00 | 31.40 | C |
| ATOM | 233 | CA | SER | A | 237 | 38.705 | 33.952 | 50.854 | 1.00 | 34.84 | C |
| ATOM | 234 | CA | SER | A | 238 | 41.114 | 35.011 | 53.589 | 1.00 | 37.98 | C |
| ATOM | 235 | CA | SER | A | 239 | 44.843 | 35.490 | 52.943 | 1.00 | 41.20 | C |
| ATOM | 236 | CA | LEU | A | 240 | 47.897 | 35.418 | 55.222 | 1.00 | 43.74 | C |
| ATOM | 237 | CA | THR | A | 241 | 51.530 | 36.005 | 54.238 | 1.00 | 46.20 | C |
| ATOM | 238 | CA | VAL | A | 242 | 54.026 | 33.504 | 55.705 | 1.00 | 47.39 | C |
| ATOM | 239 | CA | LYS | A | 243 | 57.774 | 32.768 | 55.569 | 1.00 | 47.99 | C |
| ATOM | 240 | CA | SER | A | 244 | 58.838 | 30.272 | 52.872 | 1.00 | 48.22 | C |
| ATOM | 241 | CA | GLY | A | 245 | 59.020 | 26.586 | 53.854 | 1.00 | 48.92 | C |
| ATOM | 242 | CA | ASP | A | 246 | 56.941 | 27.383 | 56.948 | 1.00 | 49.60 | C |
| ATOM | 243 | CA | GLU | A | 247 | 53.610 | 26.842 | 55.133 | 1.00 | 49.56 | C |
| ATOM | 244 | CA | HIS | A | 248 | 52.827 | 23.378 | 56.527 | 1.00 | 49.17 | C |
| ATOM | 245 | CA | HIS | A | 249 | 52.809 | 24.878 | 60.124 | 1.00 | 48.48 | C |
| ATOM | 246 | CA | TYR | A | 250 | 49.853 | 26.917 | 59.259 | 1.00 | 47.55 | C |
| ATOM | 247 | CA | CYS | A | 251 | 46.362 | 25.535 | 58.677 | 1.00 | 46.34 | C |
| ATOM | 248 | CA | CYS | A | 252 | 42.944 | 27.081 | 58.056 | 1.00 | 44.79 | C |
| ATOM | 249 | CA | ILE | A | 253 | 39.919 | 26.730 | 60.351 | 1.00 | 44.03 | C |
| ATOM | 250 | CA | VAL | A | 254 | 36.373 | 27.523 | 59.175 | 1.00 | 42.72 | C |
| ATOM | 251 | CA | GLN | A | 255 | 33.322 | 28.127 | 61.375 | 1.00 | 41.96 | C |
| ATOM | 252 | CA | HIS | A | 256 | 29.981 | 27.713 | 59.590 | 1.00 | 41.38 | C |
| ATOM | 253 | CA | ALA | A | 257 | 26.390 | 26.801 | 60.513 | 1.00 | 41.77 | C |
| ATOM | 254 | CA | GLY | A | 258 | 26.349 | 24.096 | 57.821 | 1.00 | 42.56 | C |
| ATOM | 255 | CA | LEU | A | 259 | 29.075 | 22.362 | 59.809 | 1.00 | 43.37 | C |
| ATOM | 256 | CA | ALA | A | 260 | 28.267 | 20.824 | 63.198 | 1.00 | 44.84 | C |
| ATOM | 257 | CA | GLN | A | 261 | 31.738 | 21.842 | 64.324 | 1.00 | 45.71 | C |
| ATOM | 258 | CA | PRO | A | 262 | 34.712 | 23.976 | 63.155 | 1.00 | 46.86 | C |
| ATOM | 259 | CA | LEU | A | 263 | 36.769 | 22.084 | 60.587 | 1.00 | 47.91 | C |
| ATOM | 260 | CA | ARG | A | 264 | 40.524 | 22.043 | 59.931 | 1.00 | 48.89 | C |
| ATOM | 261 | CA | VAL | A | 265 | 41.789 | 22.505 | 56.370 | 1.00 | 49.80 | C |
| ATOM | 262 | CA | GLU | A | 266 | 45.250 | 21.332 | 55.255 | 1.00 | 50.99 | C |
| ATOM | 263 | CA | LEU | A | 267 | 47.278 | 21.766 | 52.033 | 1.00 | 51.20 | C |
| TER | 264 | | LEU | A | 267 | | | | | | |
| ATOM | 265 | CA | ILE | B | 1 | 29.630 | 61.079 | 46.643 | 1.00 | 29.19 | C |
| ATOM | 266 | CA | GLN | B | 2 | 31.212 | 59.006 | 43.925 | 1.00 | 29.24 | C |
| ATOM | 267 | CA | ARG | B | 3 | 32.607 | 55.619 | 44.924 | 1.00 | 29.49 | C |
| ATOM | 268 | CA | THR | B | 4 | 35.133 | 53.608 | 42.931 | 1.00 | 29.94 | C |
| ATOM | 269 | CA | PRO | B | 5 | 34.056 | 49.958 | 42.304 | 1.00 | 29.72 | C |
| ATOM | 270 | CA | LYS | B | 6 | 35.690 | 46.893 | 43.843 | 1.00 | 29.36 | C |
| ATOM | 271 | CA | ILE | B | 7 | 36.144 | 43.872 | 41.571 | 1.00 | 28.94 | C |
| ATOM | 272 | CA | GLN | B | 8 | 36.348 | 40.239 | 42.705 | 1.00 | 28.80 | C |
| ATOM | 273 | CA | VAL | B | 9 | 36.579 | 37.262 | 40.329 | 1.00 | 28.29 | C |
| ATOM | 274 | CA | TYR | B | 10 | 35.930 | 33.674 | 41.446 | 1.00 | 27.67 | C |
| ATOM | 275 | CA | SER | B | 11 | 34.125 | 30.427 | 40.564 | 1.00 | 27.39 | C |
| ATOM | 276 | CA | ARG | B | 12 | 31.006 | 29.008 | 42.261 | 1.00 | 27.75 | C |

Figure 19 (continued)

| | | | | | | | | | | | |
|---|---|---|---|---|---|---|---|---|---|---|---|
| ATOM | 277 | CA | HIS | B | 13 | 32.705 | 25.642 | 42.855 | 1.00 | 28.70 | C |
| ATOM | 278 | CA | PRO | B | 14 | 36.448 | 24.900 | 42.990 | 1.00 | 30.10 | C |
| ATOM | 279 | CA | ALA | B | 15 | 37.934 | 24.763 | 39.483 | 1.00 | 31.85 | C |
| ATOM | 280 | CA | GLU | B | 16 | 38.440 | 21.394 | 37.774 | 1.00 | 33.67 | C |
| ATOM | 281 | CA | ASN | B | 17 | 39.587 | 21.333 | 34.141 | 1.00 | 33.41 | C |
| ATOM | 282 | CA | GLY | B | 18 | 36.888 | 19.739 | 31.969 | 1.00 | 33.27 | C |
| ATOM | 283 | CA | LYS | B | 19 | 34.199 | 20.109 | 34.646 | 1.00 | 33.38 | C |
| ATOM | 284 | CA | SER | B | 20 | 31.276 | 22.602 | 34.037 | 1.00 | 32.29 | C |
| ATOM | 285 | CA | ASN | B | 21 | 31.016 | 25.468 | 36.441 | 1.00 | 30.01 | C |
| ATOM | 286 | CA | PHE | B | 22 | 30.000 | 29.112 | 36.807 | 1.00 | 28.30 | C |
| ATOM | 287 | CA | LEU | B | 23 | 32.299 | 32.145 | 36.757 | 1.00 | 27.17 | C |
| ATOM | 288 | CA | ASN | B | 24 | 31.447 | 35.225 | 38.816 | 1.00 | 26.09 | C |
| ATOM | 289 | CA | CYS | B | 25 | 32.425 | 38.864 | 38.719 | 1.00 | 25.70 | C |
| ATOM | 290 | CA | TYR | B | 26 | 31.097 | 40.667 | 41.845 | 1.00 | 24.69 | C |
| ATOM | 291 | CA | VAL | B | 27 | 31.431 | 44.437 | 41.408 | 1.00 | 23.90 | C |
| ATOM | 292 | CA | SER | B | 28 | 30.795 | 48.246 | 44.710 | 1.00 | 23.82 | C |
| ATOM | 293 | CA | GLY | B | 29 | 31.175 | 49.434 | 46.764 | 1.00 | 24.30 | C |
| ATOM | 294 | CA | PHE | B | 30 | 30.523 | 51.921 | 43.942 | 1.00 | 25.50 | C |
| ATOM | 295 | CA | HIS | B | 31 | 28.384 | 54.996 | 43.133 | 1.00 | 27.06 | C |
| ATOM | 296 | CA | PRO | B | 32 | 26.539 | 55.973 | 40.995 | 1.00 | 27.62 | C |
| ATOM | 297 | CA | SER | B | 33 | 24.923 | 52.774 | 39.702 | 1.00 | 28.67 | C |
| ATOM | 298 | CA | ASP | B | 34 | 25.647 | 53.175 | 35.969 | 1.00 | 29.64 | C |
| ATOM | 299 | CA | ILE | B | 35 | 28.305 | 50.534 | 35.309 | 1.00 | 29.93 | C |
| ATOM | 300 | CA | GLU | B | 36 | 29.431 | 48.379 | 32.389 | 1.00 | 31.98 | C |
| ATOM | 301 | CA | VAL | B | 37 | 30.845 | 44.900 | 32.970 | 1.00 | 33.03 | C |
| ATOM | 302 | CA | ASP | B | 38 | 32.290 | 42.410 | 30.473 | 1.00 | 33.88 | C |
| ATOM | 303 | CA | LEU | B | 39 | 33.463 | 38.872 | 31.189 | 1.00 | 33.99 | C |
| ATOM | 304 | CA | LEU | B | 40 | 36.387 | 37.797 | 29.015 | 1.00 | 34.97 | C |
| ATOM | 305 | CA | LYS | B | 41 | 37.443 | 34.418 | 27.594 | 1.00 | 35.57 | C |
| ATOM | 306 | CA | ASN | B | 42 | 41.034 | 34.841 | 26.317 | 1.00 | 36.17 | C |
| ATOM | 307 | CA | GLY | B | 43 | 40.573 | 36.679 | 25.680 | 1.00 | 37.15 | C |
| ATOM | 308 | CA | GLU | B | 44 | 37.227 | 38.159 | 23.898 | 1.00 | 37.89 | C |
| ATOM | 309 | CA | ARG | B | 45 | 33.835 | 39.035 | 25.405 | 1.00 | 38.13 | C |
| ATOM | 310 | CA | ILE | B | 46 | 31.612 | 36.210 | 26.591 | 1.00 | 36.40 | C |
| ATOM | 311 | CA | GLU | B | 47 | 28.289 | 36.836 | 24.865 | 1.00 | 35.78 | C |
| ATOM | 312 | CA | LYS | B | 48 | 25.934 | 34.669 | 26.953 | 1.00 | 34.81 | C |
| ATOM | 313 | CA | VAL | B | 49 | 26.367 | 36.482 | 30.299 | 1.00 | 33.57 | C |
| ATOM | 314 | CA | GLU | B | 50 | 23.762 | 37.078 | 33.010 | 1.00 | 32.18 | C |
| ATOM | 315 | CA | HIS | B | 51 | 23.563 | 39.410 | 35.994 | 1.00 | 29.80 | C |
| ATOM | 316 | CA | SER | B | 52 | 21.637 | 39.920 | 39.240 | 1.00 | 27.33 | C |
| ATOM | 317 | CA | ASP | B | 53 | 19.579 | 42.964 | 40.275 | 1.00 | 25.92 | C |
| ATOM | 318 | CA | LEU | B | 54 | 21.576 | 46.118 | 40.850 | 1.00 | 24.91 | C |
| ATOM | 319 | CA | SER | B | 55 | 21.491 | 46.106 | 44.656 | 1.00 | 24.50 | C |
| ATOM | 320 | CA | PHE | B | 56 | 23.138 | 47.983 | 47.534 | 1.00 | 23.75 | C |
| ATOM | 321 | CA | SER | B | 57 | 24.752 | 47.528 | 50.961 | 1.00 | 23.85 | C |
| ATOM | 322 | CA | LYS | B | 58 | 24.130 | 49.472 | 54.203 | 1.00 | 23.24 | C |

Figure 19 (continued)

| | | | | | | | | | | | |
|---|---|---|---|---|---|---|---|---|---|---|---|
| ATOM | 323 | CA | ASP | B | 59 | 26.527 | 52.302 | 53.302 | 1.00 | 22.40 | C |
| ATOM | 324 | CA | TRP | B | 60 | 24.289 | 52.914 | 50.233 | 1.00 | 21.16 | C |
| ATOM | 325 | CA | SER | B | 61 | 27.073 | 51.722 | 47.903 | 1.00 | 21.42 | C |
| ATOM | 326 | CA | PHE | B | 62 | 25.965 | 49.619 | 44.924 | 1.00 | 22.43 | C |
| ATOM | 327 | CA | TYR | B | 63 | 26.852 | 45.994 | 44.234 | 1.00 | 23.92 | C |
| ATOM | 328 | CA | LEU | B | 64 | 26.235 | 43.691 | 41.264 | 1.00 | 25.87 | C |
| ATOM | 329 | CA | LEU | B | 65 | 27.066 | 40.147 | 40.184 | 1.00 | 26.65 | C |
| ATOM | 330 | CA | TYR | B | 66 | 27.823 | 39.141 | 36.610 | 1.00 | 27.35 | C |
| ATOM | 331 | CA | TYR | B | 67 | 27.924 | 35.404 | 35.967 | 1.00 | 28.29 | C |
| ATOM | 332 | CA | THR | B | 68 | 28.176 | 32.894 | 33.138 | 1.00 | 28.59 | C |
| ATOM | 333 | CA | GLU | B | 69 | 28.193 | 29.116 | 32.786 | 1.00 | 30.02 | C |
| ATOM | 334 | CA | PHE | B | 70 | 31.621 | 27.966 | 31.634 | 1.00 | 31.04 | C |
| ATOM | 335 | CA | THR | B | 71 | 34.056 | 25.047 | 31.675 | 1.00 | 34.09 | C |
| ATOM | 336 | CA | PRO | B | 72 | 37.642 | 25.804 | 32.850 | 1.00 | 35.80 | C |
| ATOM | 337 | CA | THR | B | 73 | 40.735 | 24.616 | 30.960 | 1.00 | 38.30 | C |
| ATOM | 338 | CA | GLU | B | 74 | 44.408 | 24.902 | 31.969 | 1.00 | 39.76 | C |
| ATOM | 339 | CA | LYS | B | 75 | 45.253 | 26.996 | 28.877 | 1.00 | 38.88 | C |
| ATOM | 340 | CA | ASP | B | 76 | 42.173 | 29.272 | 28.948 | 1.00 | 37.29 | C |
| ATOM | 341 | CA | GLU | B | 77 | 42.435 | 32.614 | 30.748 | 1.00 | 35.37 | C |
| ATOM | 342 | CA | TYR | B | 78 | 39.420 | 34.508 | 32.071 | 1.00 | 33.61 | C |
| ATOM | 343 | CA | ALA | B | 79 | 38.973 | 38.129 | 33.138 | 1.00 | 31.64 | C |
| ATOM | 344 | CA | CYS | B | 80 | 36.429 | 40.731 | 34.214 | 1.00 | 30.14 | C |
| ATOM | 345 | CA | ARG | B | 81 | 36.473 | 44.158 | 32.537 | 1.00 | 30.73 | C |
| ATOM | 346 | CA | VAL | B | 82 | 34.677 | 47.035 | 34.280 | 1.00 | 30.39 | C |
| ATOM | 347 | CA | ASN | B | 83 | 33.991 | 50.668 | 33.342 | 1.00 | 30.45 | C |
| ATOM | 348 | CA | HIS | B | 84 | 32.641 | 53.445 | 35.593 | 1.00 | 30.28 | C |
| ATOM | 349 | CA | VAL | B | 85 | 32.715 | 57.275 | 35.795 | 1.00 | 31.58 | C |
| ATOM | 350 | CA | THR | B | 86 | 35.304 | 57.063 | 38.596 | 1.00 | 32.26 | C |
| ATOM | 351 | CA | LEU | B | 87 | 37.731 | 55.257 | 36.241 | 1.00 | 33.69 | C |
| ATOM | 352 | CA | SER | B | 88 | 39.857 | 56.863 | 33.510 | 1.00 | 35.01 | C |
| ATOM | 353 | CA | GLN | B | 89 | 40.478 | 53.587 | 31.674 | 1.00 | 36.10 | C |
| ATOM | 354 | CA | PRO | B | 90 | 38.541 | 50.290 | 31.867 | 1.00 | 35.79 | C |
| ATOM | 355 | CA | LYS | B | 91 | 39.796 | 48.095 | 34.727 | 1.00 | 35.61 | C |
| ATOM | 356 | CA | ILE | B | 92 | 40.669 | 44.476 | 33.895 | 1.00 | 35.33 | C |
| ATOM | 357 | CA | VAL | B | 93 | 40.899 | 41.947 | 36.730 | 1.00 | 35.61 | C |
| ATOM | 358 | CA | LYS | B | 94 | 42.312 | 38.541 | 35.746 | 1.00 | 36.75 | C |
| ATOM | 359 | CA | TRP | B | 95 | 40.736 | 35.392 | 37.195 | 1.00 | 38.39 | C |
| ATOM | 360 | CA | ASP | B | 96 | 43.061 | 33.983 | 39.827 | 1.00 | 41.87 | C |
| ATOM | 361 | CA | ARG | B | 97 | 41.693 | 30.436 | 40.093 | 1.00 | 44.77 | C |
| ATOM | 362 | CA | ASP | B | 98 | 41.998 | 29.352 | 43.728 | 1.00 | 46.45 | C |
| ATOM | 363 | CA | MET | B | 99 | 40.548 | 32.626 | 45.054 | 1.00 | 47.43 | C |

END

ALBUMIN VARIANTS

CROSS-REFERENCE TO RELATED APPLICATIONS

This application claims priority or the benefit under 35 U.S.C. 119 of European application nos. 11164991.9, 11185064.0 and 12160007.6 filed on May 5, 2011, Oct. 13, 2011 and Mar. 16, 2012, respectively, and U.S. provisional application Nos. 61/482,830, 61/551,598 and 61/614,135 filed on May 5, 2011, Oct. 26, 2011 and Mar. 22, 2012, respectively, the contents of which are fully incorporated herein by reference.

REFERENCE TO A SEQUENCE LISTING

This application contains a Sequence Listing in computer readable form, which is incorporated herein by reference.

BACKGROUND OF THE INVENTION

1. Field of the Invention

The invention relates to variants of albumin or fragments thereof or fusion polypeptides comprising variant albumin or fragments thereof having a change in binding affinity to FcRn and/or a change in half-life compared to the albumin, fragment thereof or fusion polypeptide comprising albumin or a fragment thereof. The invention allows tailoring of binding affinity and/or half-life of an albumin to the requirements and desires of a user or application.

2. Description of the Related Art

Albumin is a protein naturally found in the blood plasma of mammals where it is the most abundant protein. It has important roles in maintaining the desired osmotic pressure of the blood and also in transport of various substances in the blood stream. Albumins have been characterized from many species including human, pig, mouse, rat, rabbit and goat and they share a high degree of sequence and structural homology.

Albumin binds in vivo to its receptor, the neonatal Fc receptor (FcRn) "Brambell" and this interaction is known to be important for the plasma half-life of albumin. FcRn is a membrane bound protein, expressed in many cell and tissue types. FcRn has been found to salvage albumin from intracellular degradation (Roopenian D. C. and Akilesh, S. (2007), *Nat. Rev. Immunol* 7, 715-725). FcRn is a bifunctional molecule that contributes to maintaining a high level of IgGs and albumin in serum in mammals such as human beings.

Whilst the FcRn-immunoglobulin (IgG) interaction has been characterized in the prior art, the FcRn-albumin interaction is less well characterized. The major FcRn binding site is localized within DIII (381-585). Andersen et al (2010), Clinical Biochemistry 43, 367-372. Data indicates that IgG and albumin bind non-cooperatively to distinct sites on FcRn (Andersen et al. (2006), *Eur. J. Immunol* 36, 3044-3051; Chaudhury et al. (2006), *Biochemistry* 45, 4983-4990).

It is known that mouse FcRn binds IgG from mice and humans whereas human FcRn appears to be more discriminating (Ober et al. (2001) *Int. Immunol* 13, 1551-1559). Andersen et al. (2010) Journal of Biological Chemistry 285 (7):4826-36, describes the affinity of human and mouse FcRn for each mouse and human albumin (all possible combinations). No binding of albumin from either species was observed at physiological pH to either receptor. At acidic pH, a 100-fold difference in binding affinity was observed. In all cases, binding of albumin and IgG from either species to both receptors were additive.

Human serum albumin (HSA) has been well characterized as a polypeptide of 585 amino acids, the sequence of which can be found in Peters, T., Jr. (1996) *All about Albumin: Biochemistry, Genetics and Medical, Applications* pp 10, Academic Press, Inc., Orlando (ISBN 0-12-552110-3). It has a characteristic binding to its receptor FcRn, where it binds at pH 6.0 but not at pH 7.4.

The plasma half-life of HSA has been found to be approximately 19 days. A natural variant having lower plasma half-life has been identified (Peach, R. J. and Brennan, S. 0., (1991) *Biochim Biophys Acta.* 1097:49-54) having the substitution D494N. This substitution generated an N-glycosylation site in this variant, which is not present in the wild-type albumin. It is not known whether the glycosylation or the amino acid change is responsible for the change in plasma half-life.

Albumin has a long plasma half-life and because of this property it has been suggested for use in drug delivery. Albumin has been conjugated to pharmaceutically beneficial compounds (WO 2000/69902A), and it was found that the conjugate maintained the long plasma half-life of albumin. The resulting plasma half-life of the conjugate was generally considerably longer than the plasma half-life of the beneficial therapeutic compound alone.

Further, albumin has been genetically fused to therapeutically beneficial peptides (WO 2001/79271 A and WO 2003/59934 A) with the typical result that the fusion has the activity of the therapeutically beneficial peptide and a considerably longer plasma half-life than the plasma half-life of the therapeutically beneficial peptides alone.

Otagiri et al (2009), Biol. Pharm. Bull. 32 (4), 527-534, discloses more than 70 albumin variants, of these 25 of these are found to be mutated in domain III. A natural variant lacking the last 175 amino acids at the carboxy termini has been shown to have reduced half-life (Andersen et al (2010), Clinical Biochemistry 43, 367-372). Iwao et al (2007) studied the half-life of naturally occurring human albumin variants using a mouse model, and found that K541E and K560E had reduced half-life, E501K and E570K had increased half-life and K573E had almost no effect on half-life (Iwao, et. al. (2007) B.B.A. Proteins and Proteomics 1774, 1582-1590).

Galliano et al (1993) Biochim. Biophys. Acta 1225, 27-32 discloses a natural variant E505K. Minchiotti et al (1990) discloses a natural variant K536E. Minchiotti et al (1987) Biochim. Biophys. Acta 916, 411-418 discloses a natural variant K574N. Takahashi et al (1987) Proc. Natl. Acad. Sci. USA 84, 4413-4417, discloses a natural variant D550G. Carlson et al (1992). Proc. Nat. Acad. Sci. USA 89, 8225-8229, discloses a natural variant D550A.

WO2011/051489 (PCT/EP2010/066572) discloses a number of point mutations in albumin which modulate the binding of albumin to FcRn, WO2010/092135 discloses a number of point mutations in albumin which increase the number of thiols available for conjugation in the albumin, the disclosure is silent about the affect of the mutations on the binding of the albumin to FcRn. WO2011/103076 discloses albumin variants, each containing a substitution in Domain III of HSA.

Albumin has the ability to bind a number of ligands and these become associated (associates) with albumin. This property has been utilized to extend the plasma half-life of drugs having the ability to non-covalently bind to albumin. This can also be achieved by binding a pharmaceutical beneficial compound, which has little or no albumin binding properties, to a moiety having albumin binding properties. See review article and reference therein, Kratz (2008) Journal of Controlled Release 132, 171-183.

Albumin is used in preparations of pharmaceutically beneficial compounds, in which such a preparation maybe for example, but not limited to, a nanoparticle or microparticle of albumin. In these examples the delivery of a pharmaceutically beneficial compound or mixture of compounds may benefit from alteration in the albumin's affinity to its receptor where the beneficial compound has been shown to associate with albumin for the means of delivery.

It is not clear what determines the plasma half-life of the formed associates (for example but not limited to LEVEMIR® brand anti-diabetic preparation, Kurtzhals P et al. Biochem. J. 1995; 312:725-731), conjugates or fusion polypeptides but it appears to be a result of the combination of the albumin and the selected pharmaceutically beneficial compound/polypeptide. It would be desirable to be able to control the plasma half-life of given albumin conjugates, associates or albumin fusion polypeptides so that a longer or shorter plasma half-life can be achieved than given by the components of the association, conjugation or fusion, in order to be able to design a particular drug according to the particulars of the indication intended to be treated.

Albumin is known to accumulate and be catabolised in tumours, it has also been shown to accumulate in inflamed joints of rheumatoid arthritis sufferers. See review article and reference therein, Kratz (2008) Journal of Controlled Release 132, 171-183. It is envisaged that HSA variants with increased affinity for FcRn would be advantageous for the delivery of pharmaceutically beneficial compounds.

It may even be desirable to have variants of albumin that have little or no binding to FcRn in order to provide shorter half-lives or controlled serum pharmacokinetics as described by Kenanova et al (2009) *J. Nucl. Med.;* 50 (Supplement 2):1582).

Kenanova et al (2010, Protein Engineering, Design & Selection 23 (10): 789-798; WO2010/118169) discloses a docking model comprising a structural model of domain III of HSA (solved at pH 7 to 8) and a structural model of FcRn (solved at pH 6.4). Kenanova et al discloses that positions 464, 505, 510, 531 and 535 in domain III potentially interact with FcRn. The histidines at positions 464, 510 and 535 were identified as being of particular interest by Chaudhury et al., (2006) and these were shown to have a significant reduction in affinity and shorter half-life in mouse by Kenanova (2010). However, the studies of Kenanova et al are limited to domain III of HSA and therefore do not consider HSA in its native intact configuration. Furthermore, the identified positions result in a decrease in affinity for the FcRn receptor.

International patent application WO2011/051489 (PCT/EP10/066,572) discloses a first class of variant albumins having modulated (i.e. increased or decreased) binding affinity to FcRn receptor due to the presence of one or more point mutations in the albumin sequence. International patent application WO2011/124718 (PCT/EP2011/055577) discloses a second class of variant albumins having modulated binding affinity to FcRn receptor, the variants comprise domain III of an albumin with one or more other domains of albumin and optionally include one or more point mutations.

The present invention further variants having modulated binding affinity to the FcRn receptor and, through provision of a range of molecules, allows binding affinity (and therefore) half-life to be tailored according to requirements. Such tailoring may range from a large increase in binding affinity to FcRn and/or half-life to a small increase in binding affinity to FcRn and/or half-life, a small decrease in binding affinity to FcRn and/or half-life to a large decrease in binding affinity to FcRn and/or half-life. The albumin moiety or moieties may therefore be used to tailor the binding affinity to FcRn and/or half-life of fusion polypeptides, conjugates, associates, nanoparticles and compositions comprising the albumin moiety.

SUMMARY OF THE INVENTION

The invention provides a method of identifying and/or designing variants of albumin which have improved properties compared to a parent albumin. WO2011/051489 (PCT/EP2010/066572) discloses a number of point mutations in albumin which modulate the binding of albumin to FcRn. The point mutations were used to prepare a docking model comprising HSA and FcRn. The docking model was used to identify regions of albumin which interact with FcRn during binding and therefore whose mutation will alter binding affinity between albumin and FcRn, relative to the binding affinity between wild-type HSA and FcRn.

The invention provides variants of an albumin with improved properties compared to its parent or reference. In particular the invention provides variants of an albumin having altered binding affinity to FcRn and/or an altered plasma half-life compared to its parent or reference.

Therefore the invention relates to isolated variants of albumin or fragments thereof, or fusion polypeptides comprising variant albumin or fragments thereof, of a parent or reference albumin, comprising an alteration at one or more (several) positions corresponding to positions in an albumin equivalent to positions in SEQ ID NO: 2 selected from: (a) 492 to 538; (b) 505, 531, 524, 472, 108, 190, 197 and 425; (c) 186 to 201; (d) 457 to 472; (e) 414 to 426; (f) 104 to 120; (g) 75 to 91; (h) 144 to 150; (i) 30 to 41, (j) 550 to 585 and (k) 276, 410 and 414 with one or more (several) of A, C, D, E, F, G, H, I, K, L, M, N, P, Q, R, S, T, V, W, Y and/or a stop codon at a position from 497 to 585;

wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, and/or (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or (iii) the group consisting of positions 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585.

The invention also comprises introduction of a stop codon at a position from residue 497 to 585, i.e. any of positions 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585 (or equivalent position, relative to SEQ ID NO: 2). Introduction of a stop codon may be instead of or together with the one or more (several) alterations mentioned herein.

The invention provides an albumin variant or fragment thereof having altered binding affinity to FcRn compared with a parent or reference albumin, comprising an alteration (such as a substitution, deletion or insertion) at:

(a) one or more (several) positions corresponding to the following positions of SEQ ID No: 2: any of 30, 31, 32, 33, 35, 36, 37, 39, 41, 77, 78, 79, 81, 84, 85, 87, 88, 89, 105, 106, 107, 108, 109, 110, 111, 112, 117, 118, 120, 144, 145, 146, 147, 148, 149, 150, 186, 187, 188, 189, 190, 191, 192, 193, 194, 195, 196, 197; and/or (b) one or more (several) positions corresponding to the following positions of SEQ ID No: 2: any of 189, 190, 191, 192, 193, 194, 195, 196, 197, 198, 199, 276; and/or (c) one or more (several) positions corresponding to the following positions of SEQ ID No: 2: 410, 411, 414, 415, 416, 418, 419, 420, 421, 422, 423, 424, 425, 426, 457, 458, 459, 460, 462, 463, 465, 466, 467, 468, 469, 470, 472, 497, 498, 502, 507, 508, 509, 511, 515, 516, 517, 518, 519, 520, 521, 522, 523, 524, 525, 526, 527, 528, 529, 530, 531, 532, 534, 551, 552, 553, 554, 555, 556, 557, 561, 566, 568, 569, 570, 571, 572, 576, 583 wherein the altered binding affinity of the variant or fragment thereof is relative to the binding affinity of a reference such as a parent albumin or fragment which does not comprise the alteration.

The positions described in (a) (above) may be in a first Domain (e.g. Domain I) of a polypeptide such as an albumin, e.g. HSA. The positions described in (b) (above) may be in a second Domain (e.g. Domain II) of a polypeptide such as an albumin, e.g. HSA. The positions described in (c) (above) may be in a third Domain (e.g. Domain IIII) of a polypeptide such as an albumin, e.g. HSA.

The albumin variant or fragment thereof may further comprise an alteration (such as a substitution or insertion) at one more (several) positions corresponding to the following positions of SEQ ID No: 2:

(i) any of 417, 464, 492, 493, 494, 495, 496, 499, 500, 501, 503, 504, 505, 506, 510, 535, 536, 537, 538, 540, 550, 573, 574, 575, 577, 578, 579, 580, 581, 582, 584, (ii) any of 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or (iii) any of 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E).

It is preferred that the parent albumin and/or the variant albumin comprises or consists of:

(a) a polypeptide having at least 60% sequence identity to the mature polypeptide of SEQ ID NO: 2;

(b) a polypeptide encoded by a polynucleotide that hybridizes under low stringency conditions with (i) the mature polypeptide coding sequence of SEQ ID NO: 1, or (ii) the full-length complement of (i);

c) a polypeptide encoded by a polynucleotide having at least 60% identity to the mature polypeptide coding sequence of SEQ ID NO: 1; and/or (d) a fragment of the mature polypeptide of SEQ ID NO: 2.

The alteration at one or more position may independently be selected among substitutions, insertions and deletions, where substitutions are preferred.

The invention also relates to isolated polynucleotides encoding the variants; nucleic acid constructs, vectors, and host cells comprising the polynucleotides; and methods of producing the variants.

The invention also relates to conjugates or associates comprising the variant albumin or fragment thereof according to the invention and a beneficial therapeutic moiety or to a fusion polypeptide comprising a variant albumin or fragment thereof of the invention and a fusion partner polypeptide.

The invention further relates to compositions comprising the variant albumin, fragment thereof, fusion polypeptide comprising variant albumin or fragment thereof or conjugates comprising the variant albumin or fragment thereof, according to the invention or associates comprising the variant albumin or fragment thereof, according to the invention. The compositions are preferably pharmaceutical compositions.

The invention further relates to a pharmaceutical composition comprising a variant albumin, fragment thereof, fusion polypeptide comprising variant albumin or fragment thereof or conjugates comprising the variant albumin or fragment thereof, or associates comprising the variant albumin or fragment thereof, wherein said variant albumin, fragment thereof, fusion polypeptide comprising variant albumin or fragment thereof or conjugates comprising the variant albumin or fragment or associates of variant albumin or fragment thereof has altered binding affinity to FcRn and/or an altered plasma half-life compared to the corresponding binding affinity and/or plasma half-life of the HSA or fragment thereof, fusion polypeptide comprising HSA or fragment thereof or conjugates or associates of HSA or, fragment thereof, comprising HSA or fragment thereof.

BRIEF DESCRIPTION OF THE FIGURES

The patent or application file contains at least one drawing executed in color. Copies of this patent or patent application publication with color drawing(s) will be provided by the Office upon request and payment of the necessary fee.

In FIG. 4, Domains I, II and III are referred to as 1, 2 and 3 (respectively).

FIG. 4: Domain architecture of HSA and shFcRn binding properties of HSA hybrid molecules. (A) Overall structure of shFcRn showing the location of the pH-dependent flexible loop (orange ribbon immediately below 'His 166' label)) and His-166 relative to the IgG binding site (red residues in ball-and-stick (ball and stick residues below 'α2' label and to left of 'Glu115, Glu116' and 'IgG' labels) (23). (B) The crystal structure of full-length HSA consists of three α-helical domains; DI (pink), DII (orange) and DIII (cyan/blue) (19). The DIII is split into sub-domains DIIIa (cyan) and DIIIb (blue). (C) Domain organization of constructed hybrid HSA molecules (DI-DII, DI-DIII, DII-DIII, DIII; the domains are shaded in the same scheme as FIGS. 4A and 4B). (D) SDS-PAGE gel migration of the HSA domain variants. (E) SPR sensorgrams of WT HSA and domain combinations injected over immobilized shFcRn at pH 6.0. (F) ELISA showing pH dependent binding of WT HSA, HSA DIIIa and HSA Bartin to shFcRn at pH 7.4 and pH 6.0.

(A) An overview of the docked molecules in two orientations showing the FcRn HC (green, labeled 'FcRnα1', 'FcRnα2' and 'FcRnα3'), β2m (gray) and the three HSA α-helical domains DI (pink), DII (orange) and DIII (cyan/blue). The DIII sub-domain is split into DIIIa (cyan) and DIIIb (blue).

(B) Close-up view of the interaction interface between shFcRn (green cartoon) and HSA (blue surface shown by space filling diagram (in greyscale: darker grey)) in the docking model. The C-terminal end of HSA (dark blue (in greyscale: darker grey)) and the loop corresponding to residues 490-510 between sub-domains DIIIa and DIIIb form a crevice on the HSA surface into which the pH-dependent and flexible loop in shFcRn (residues 51-59) might bind. His-166 of shFcRn may form strong, charge-stabilized interactions with HSA residues Glu-54 and Glu-505. HSA Glu-505 could further interact with shFcRn Arg-162. Possible salt-bridges are formed between Lys-150 and Glu-151 of shFcRn with Glu-501 and Lys-500 of HSA. A cleft on the HSA surface is formed between the loop connecting DIIIa and DIIIb and the α-helix encompassing residues 520-535. His-161 of shFcRn may interact with Glu-531 of HSA at low pH, and the complex could be further reinforced by the salt bridge between shFcRn Glu-168 and HSA Lys-524.

(C) Interaction interface between shFcRn (green surface (space filling diagram at bottom left of figure) and HSA (pink, blue and cyan cartoon (ribbon diagram)) in the docking model. A β-hairpin loop in shFcRn is wedged in-between domains DI (pink, including labels Lys190, Asp108 and Arg197) and DIIIa (cyan, including labels Glu425 and His464) in HSA. The shFcRn Asp110 could be a partner to either Lys190 or Arg197 of HSA following some structural rearrangements in this interface. The conserved His464 is located in the DIIIa α-helix contacting the β-hairpin loop.

Figure 9:
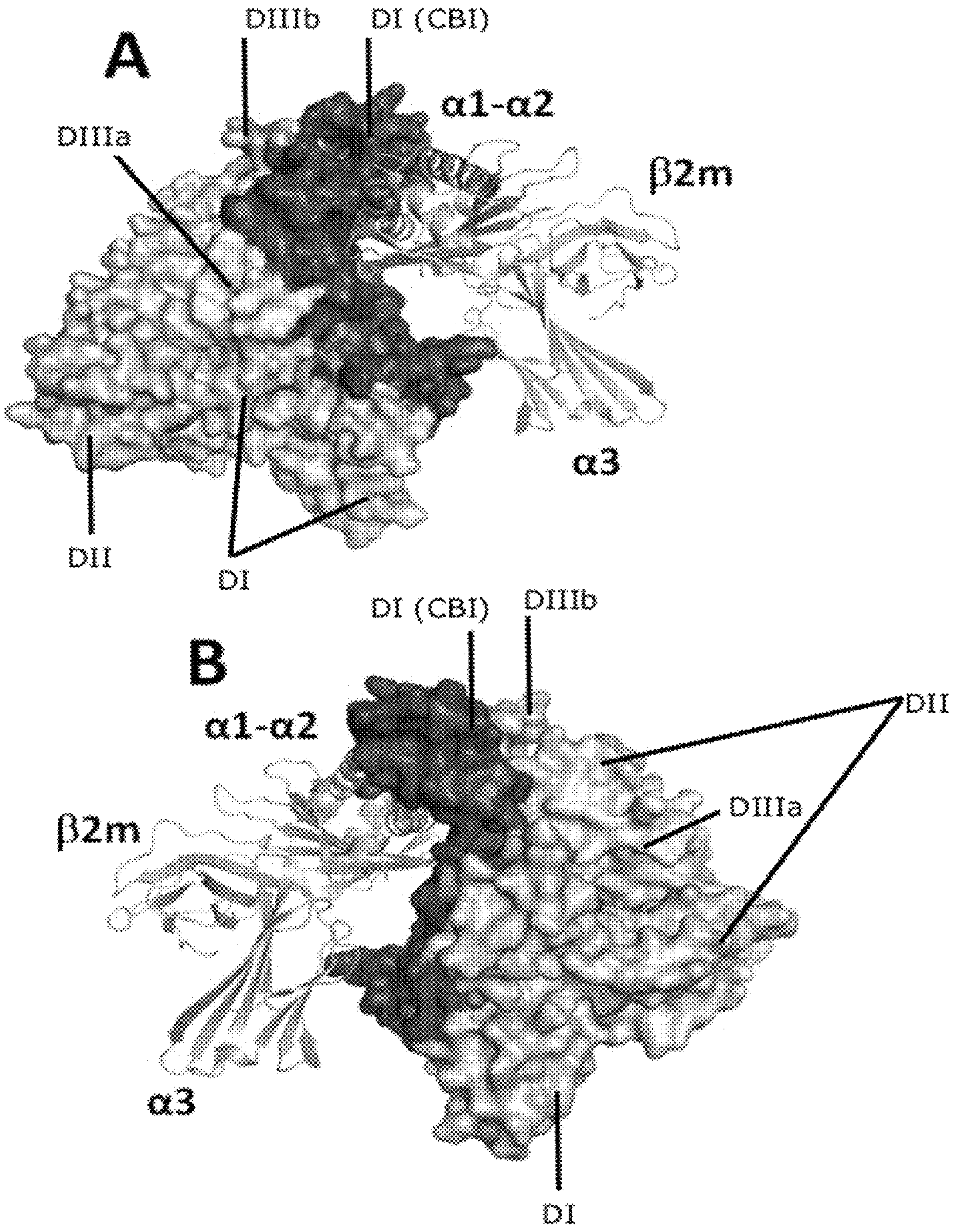

FIG. 9: Representation of shFcRn-HSA docking model. (A-B) Two orientations of the complex are shown. Albumin is shown by a space-filling diagram, FcRn is shown as a ribbon diagram. The core binding interface of HSA is highlighted in pink (in grey-scale this is seen as the darkest (almost black) region; DI (CBI)), while the area distally localized from the interface is shown as DII (orange) and DIII is split into sub-domains DIIIa (cyan) and DIIIb (blue).

Figure 10:
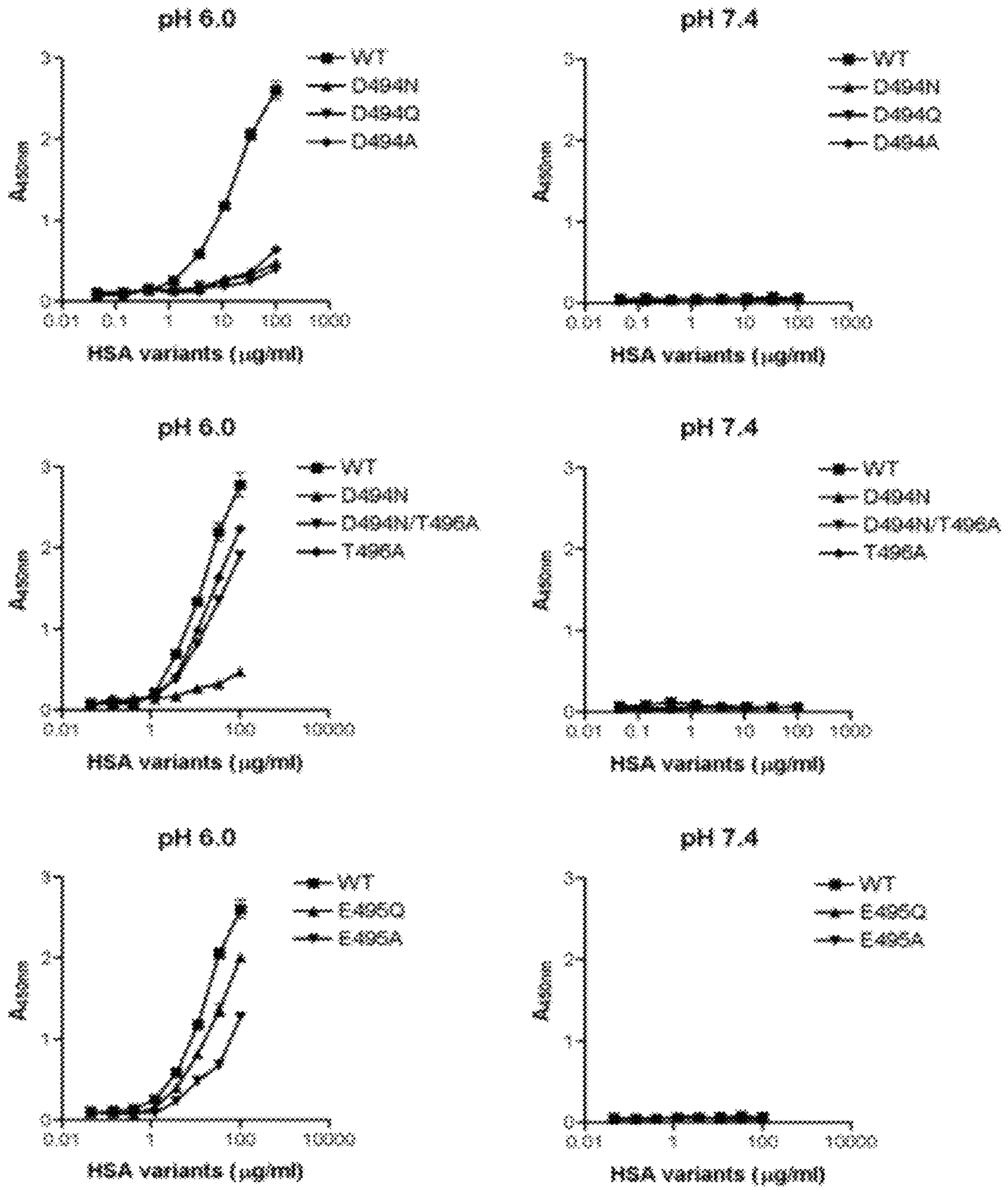

FIG. 10: Binding of shFcRn-GST to HSA Casebrook mutations series (100-0.045 μg/ml) at pH 6.0 and pH 7.4. The ELISA values represent the mean of duplicates.

Figure 11:
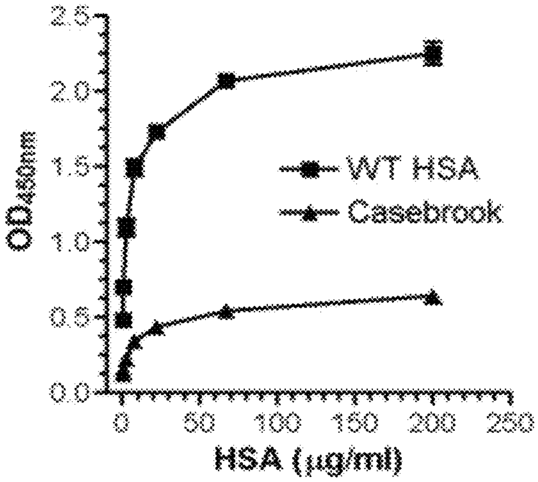

FIG. 11: Binding of Casebrook HSA variant isolated from a heterozygous individual and WT HSA (200-1.625 μg/ml) to shFcRn-GST at pH6.0.

Figure 12:
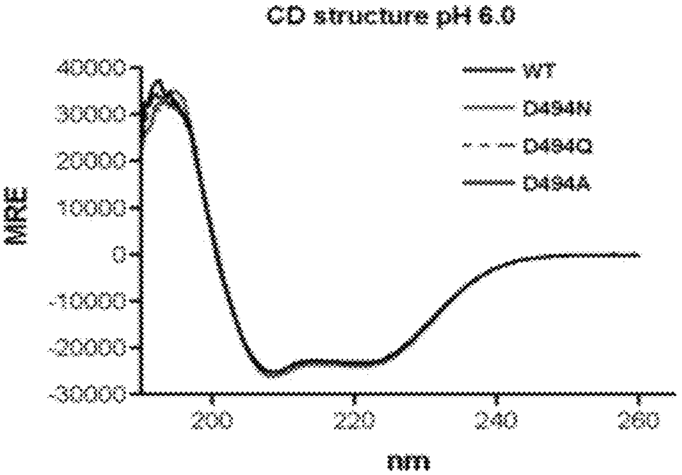

FIG. 12: CD spectra of WT HSA and Casebrook variants at pH 6.0. 5 μM of each variant was evaluated and the spectra shown represent the average of 5 runs.

Figure 13:
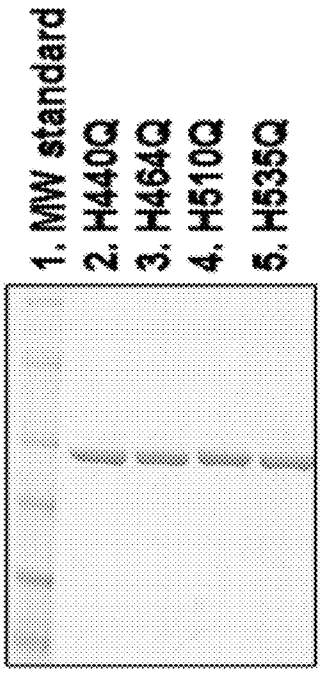

FIG. 13: Reducing SDS-PAGE analysis of histidine variants of HSA. Lane 1, SeeBlue® Plus2 (6 μl) and 1 μg per lane of each (2) H440Q, (3) H464Q, (4) H510Q and (5) H535Q.

Figure 14:
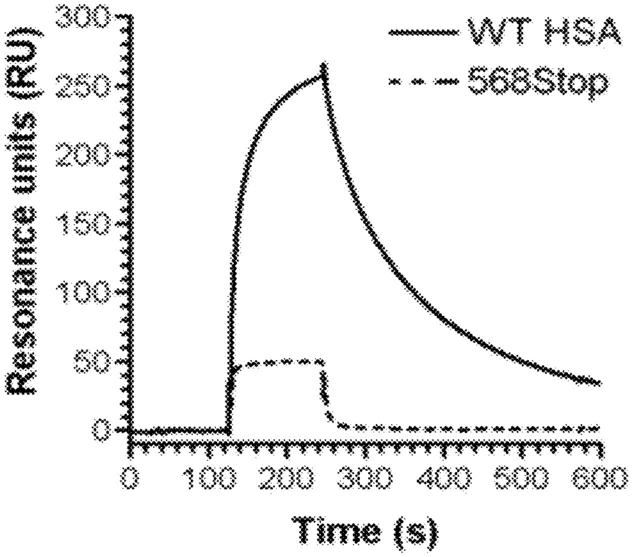

FIG. 14: Binding of truncated WT HSA and HSA variant 568stop (truncated variant that lacks the last 17 amino acids). Binding of C-terminal truncated HSA variant HSA to shFcRn. 10 μM of each was injected over immobilised shFcRn (2000 RU) at pH 6.0.

Figure 15:
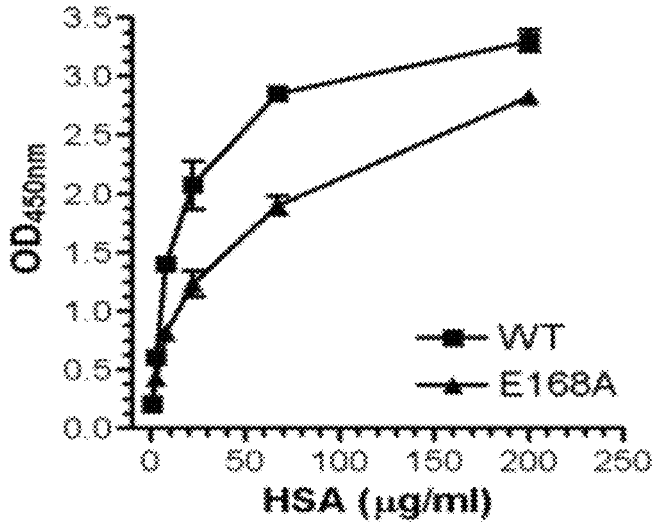

FIG. 15: Binding of shFcRn-GST to WT HSA and HSA E168A (200-0.045 μg/ml) at pH 6.0 and pH 7.4. The ELISA values represent the mean of duplicates.

Figure 16:
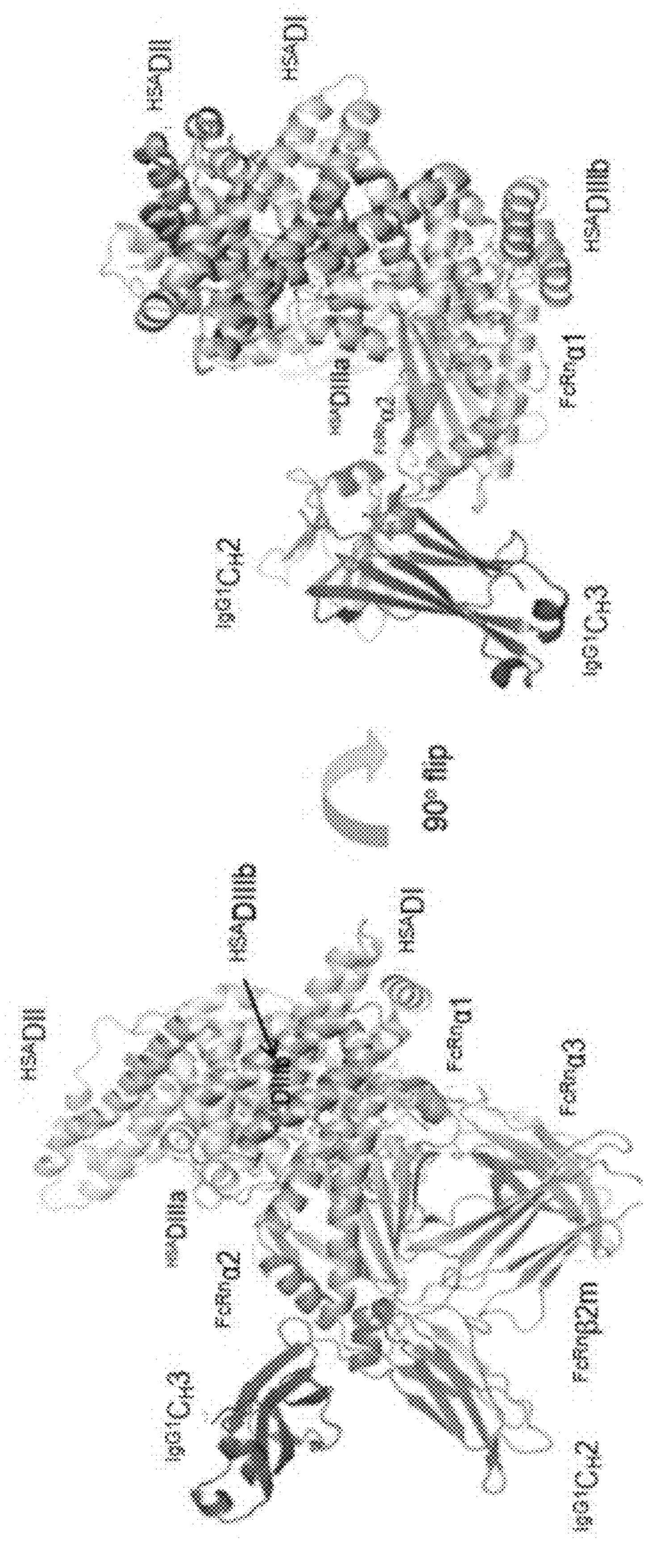

FIG. 16: A proposed shFcRn-HSA docking model showing, in two orientations, the simultaneous binding of the two ligands (IgG and HSA) to FcRn.

Figure 17:
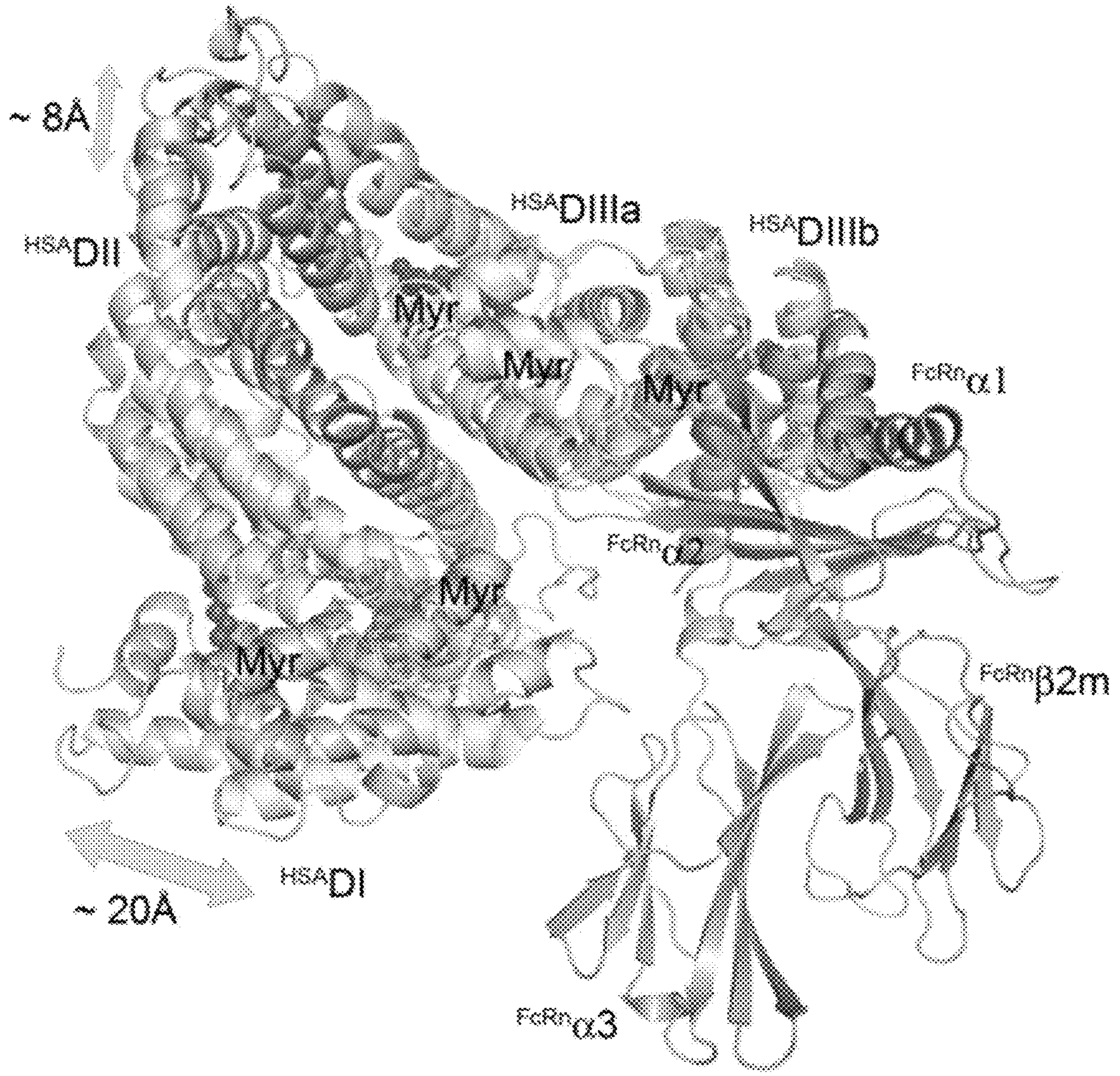

FIG. 17: Comparison of the fatty acid bound and the free state of HSA showing no substantial rearrangements within sub-domain DIII of HSA upon binding, but a considerable shift in orientation of HSA DI relative to HSA DIII. Myr: myristate; β2m: β2-microglobulin FIG. 18: is an extract of the alpha carbons from the PDB file of HSA (SEQ ID No. 2) from the docking model of HSA and FcRn described in Example 1.

FIG. 19: is an extract of the alpha carbons from the PDB file of FcRn (SEQ ID No. of FcRn) from the docking model of HSA and FcRn described in Example 1.

Figure 20:
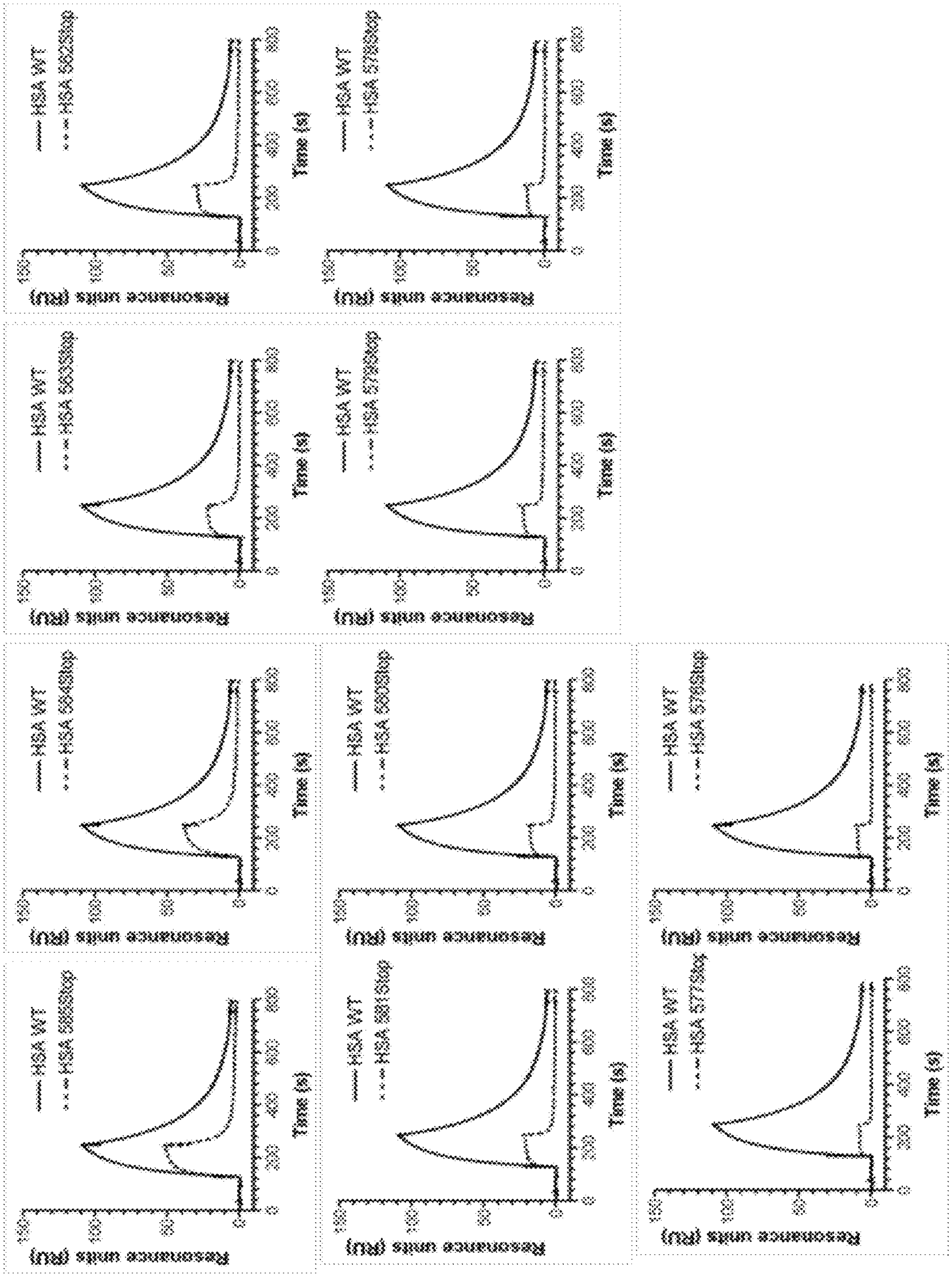

FIG. 20: Binding of C-terminal truncated HSA variants to shFcRn. 10 μM of each variant was injected over immobilized shFcRn-GST (2000 RU) at pH 6.0.

Figure 21:
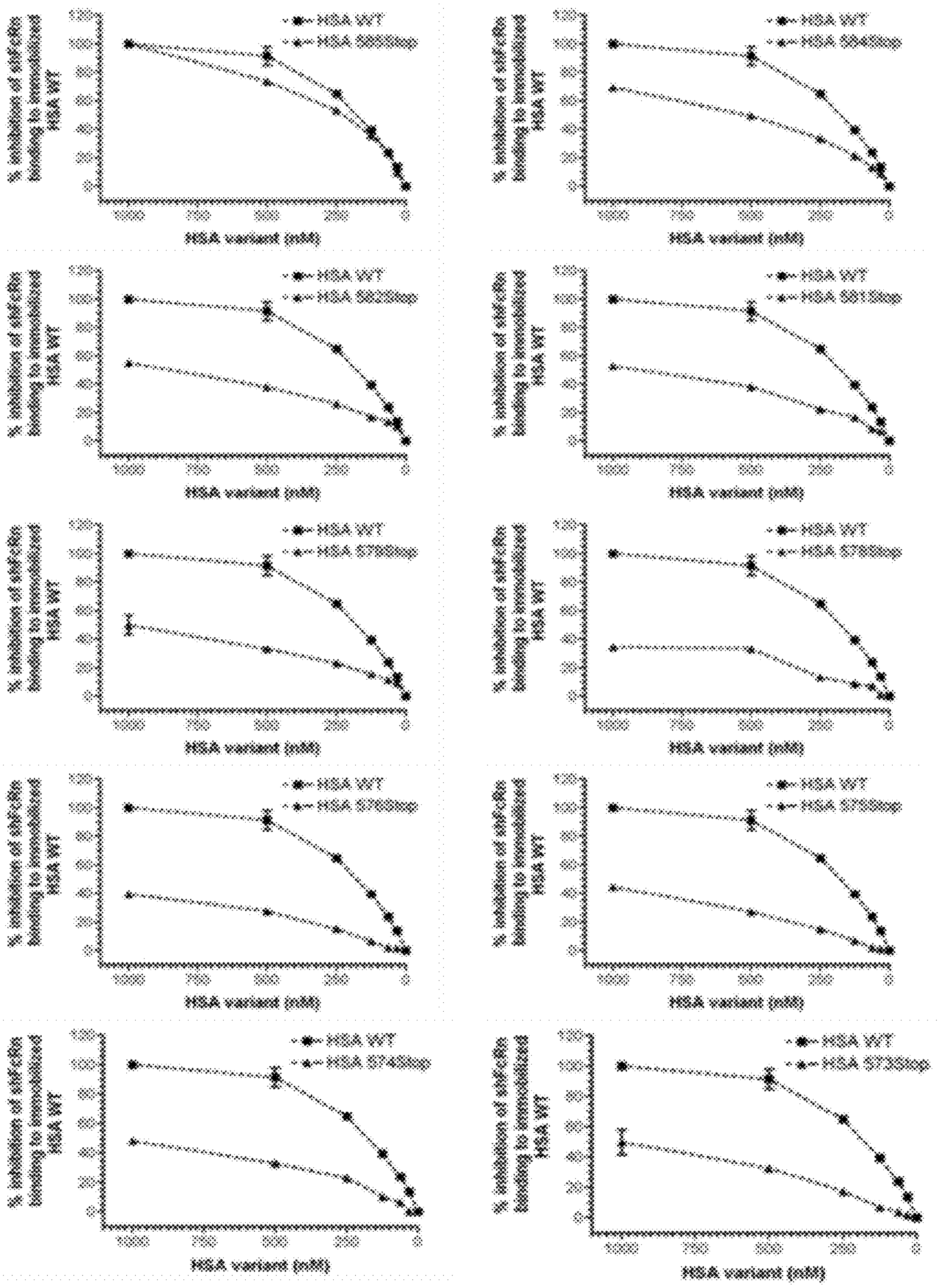
Figure 21:
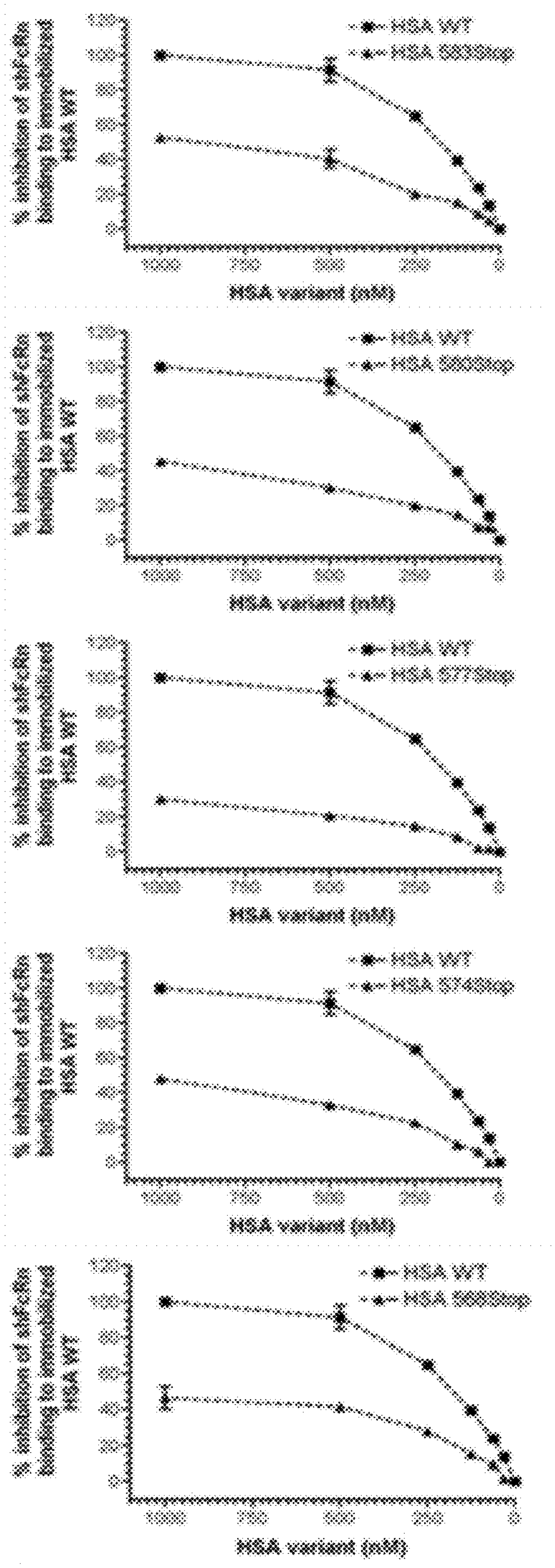

FIG. 21: Competitive binding of C-terminal truncated HSA variants. Competitive binding was measure by injecting shFcRn-GST (100 nM) alone or together with serial dilutions of HSA variants over immobilized HSA (2200 RU) at pH 6.0

Figure 22:
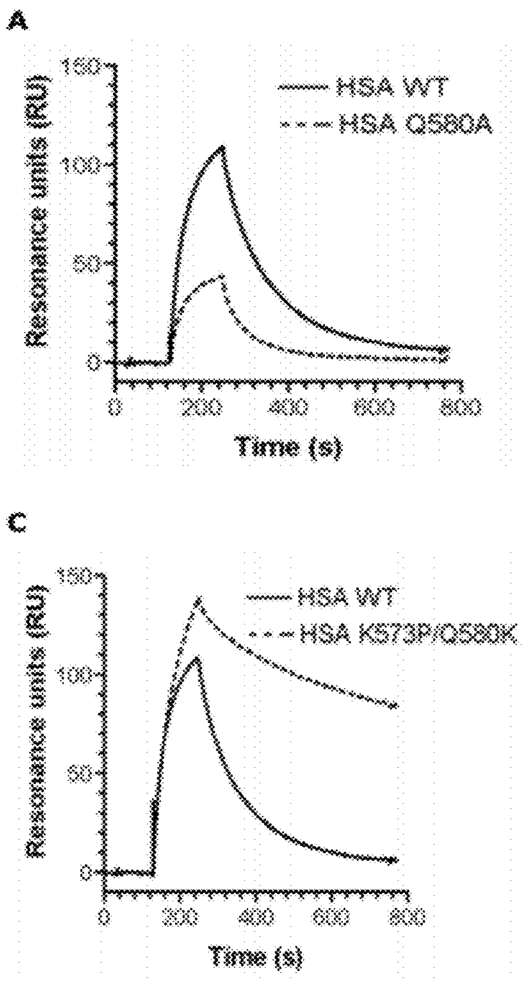

FIG. 22: Point mutations in the C-terminal end of HSA modulate binding to shFcRn. 10 μM of HSA WT and HSA (A) HSA Q580A, (B) HSA K574A and (C) HSA K573P/Q580A were injected over immobilized shFcRn-GST (2000 RU) at pH 6.0.

Figure 23:
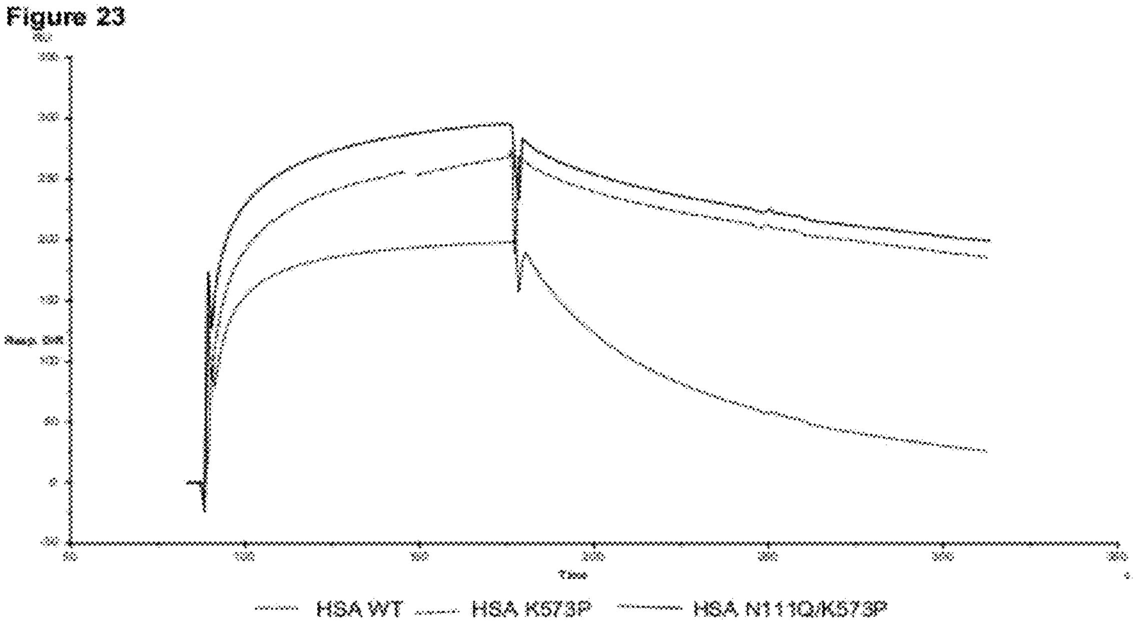

FIG. 23: shFcRn binding of WT HSA, HSA K573P and HSA N111Q/K573P at pH5.5, samples were injected over immobilized shFcRn-HIS (~1500-2500 RU) at pH 5.5.

Figure 24:
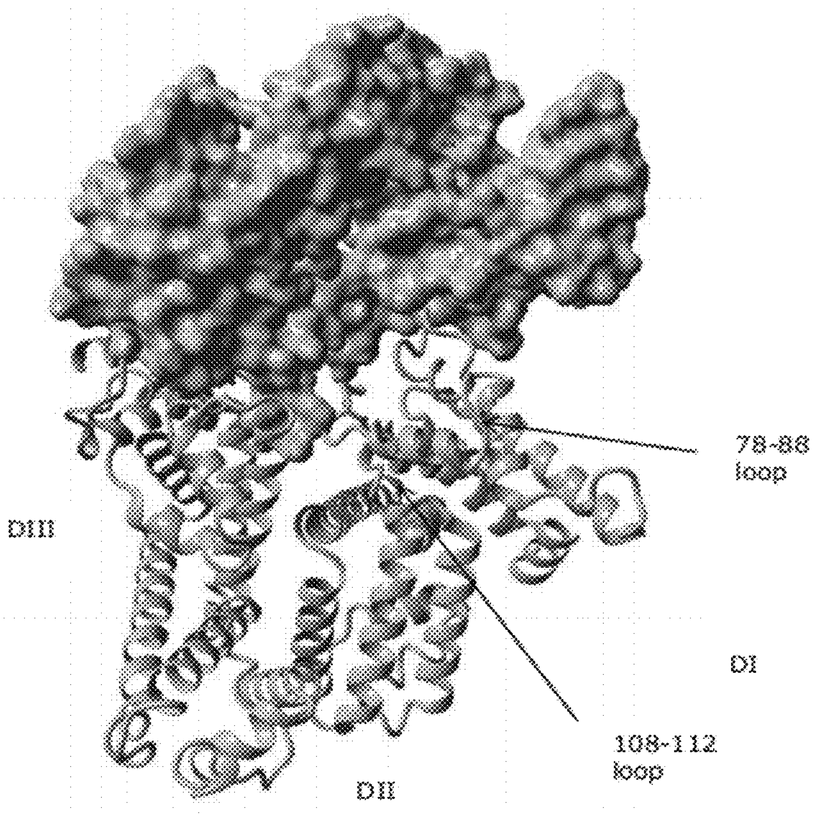

FIG. 24: A proposed shFcRn-HSA docking model, showing the spatial relationship between shFcRn (space filling diagram) and HSA (ribbon diagram) DI, DII and DIII including loops of HSA comprising positions 78-88 and 108-112.

DETAILED DESCRIPTION OF THE INVENTION

The invention relates to isolated variants of albumin or fragments thereof, or fusion polypeptides comprising variant albumin or fragments thereof, of a parent or reference albumin, comprising an alteration at one or more (several) positions which affect and/or are involved in the interaction between albumin and FcRn, preferably an alteration at one or more (several) positions corresponding to positions 30 to 41, 75 to 91, 104 to 120, 144 to 150, 186 to 201, 414 to 426, 457 to 472, 492 to 538, 550 to 585, 276, 410, and/or 411 of the mature polypeptide of SEQ ID NO: 2, wherein, it is preferred that, when the variant, fragment or fusion thereof comprises one or more (several) substitutions at positions selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584 and/or (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue) the variant, fragment or fusion thereof also comprises one or more (several) alterations at a position selected from group consisting of 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585.

Preferred alterations include those made at positions equivalent to 534, 505, 111, 527, 510 and/or 108 (positions are with reference to SEQ ID No: 2). More preferred are substitutions K534V, E505Q, N111D, T527M, H510D and D108A or such substitutions at positions equivalent thereto. Substitutions K534I, K534L, D108E and N111E, or such substitutions at positions equivalent thereto, are also preferred because they are highly conserved substitutions of K534V, D108A and N111D. Alterations at positions equivalent to a loop comprising positions 105 to 120 (with reference to SEQ ID No: 2) are preferred, more preferred are positions equivalent to positions 106 to 115 and even more preferred positions equivalent to 108, 109, 110, 111 and 112. The skilled person can identify positions equivalent to those of SEQ ID No: 2 as described herein.

The invention provides an albumin variant or fragment thereof having altered binding affinity to FcRn compared with a parent or reference albumin, comprising an alteration (such as a substitution, deletion or insertion) at:

(a) one or more (several) positions corresponding to the following positions of SEQ ID No: 2: any of 30, 31, 32, 33, 35, 36, 37, 39, 41, 77, 78, 79, 81, 84, 85, 87, 88, 89, 105, 106, 107, 108, 109, 110, 111, 112, 117, 118, 120, 144, 145, 146, 147, 148, 149, 150, 186, 187, 188, 189, 190, 191, 192, 193, 194, 195, 196, 197; and/or (b) one or more (several) positions corresponding to the following positions of SEQ ID No: 2: any of 189, 190, 191, 192, 193, 194, 195, 196, 197, 198, 199, 276; and/or (c) one or more (several) positions corresponding to the following positions of SEQ ID No: 2: 410, 411, 414, 415, 416, 418, 419, 420, 421, 422, 423, 424, 425, 426, 457, 458, 459, 460, 462, 463, 465, 466, 467, 468, 469, 470, 472, 497, 498, 502, 507, 508, 509, 511, 515, 516, 517, 518, 519, 520, 521, 522, 523, 524, 525, 526, 527, 528, 529, 530, 531, 532, 534, 551, 552, 553, 554, 555, 556, 557, 561, 566, 568, 569, 570, 571, 572, 576, 583 wherein the altered binding affinity of the variant or fragment thereof is relative to the binding affinity of a reference such as a parent albumin or fragment which does not comprise the alteration.

The positions described in (a) (above) may be in a first Domain (e.g. Domain I) of a polypeptide such as an albumin, e.g. HSA. The positions described in (b) (above) may be in a second Domain (e.g. Domain II) of a polypeptide such as an albumin, e.g. HSA. The positions described in (c) (above) may be in a third Domain (e.g. Domain IIII) of a polypeptide such as an albumin, e.g. HSA.

The albumin variant or fragment thereof may further comprise an alteration (such as a substitution or insertion) at one more (several) positions corresponding to the following positions of SEQ ID No: 2:

(i) any of 417, 464, 492, 493, 494, 495, 496, 499, 500, 501, 503, 504, 505, 506, 510, 535, 536, 537, 538, 540, 550, 573, 574, 575, 577, 578, 579, 580, 581, 582, 584, (ii) any of 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or (iii) any of 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E).

It is preferred that the parent albumin and/or the variant albumin comprises or consists of:

(a) a polypeptide having at least 60% sequence identity to the mature polypeptide of SEQ ID NO: 2;

(b) a polypeptide encoded by a polynucleotide that hybridizes under low stringency conditions with (i) the mature polypeptide coding sequence of SEQ ID NO: 1, or (ii) the full-length complement of (i);

c) a polypeptide encoded by a polynucleotide having at least 60% identity to the mature polypeptide coding sequence of SEQ ID NO: 1; and/or (d) a fragment of the mature polypeptide of SEQ ID NO: 2.

The alteration at one or more position may independently be selected among substitutions, insertions and deletions, where substitutions are preferred.

The invention also comprises introduction of a stop codon at a position from residue 497 to 585 (or equivalent position, relative to SEQ ID NO: 2) or from residue 497 (or equivalent position, relative to SEQ ID NO: 2) to the last residue of the mature sequence of the albumin. Introduction of a stop codon may be instead of or together with the one or more (several) alterations mentioned herein.

The invention allows the binding affinity (and therefore the half-life) of an albumin moiety for the FcRn receptor to be tailored to meet the requirements of a particular user or application. Such tailoring may range from a large increase in half-life to a small increase in half-life, a small decrease in half-life to a large decrease in half-life. The albumin moiety or moieties may therefore be used to tailor the half-life of fusion polypeptides, conjugates, associates, nanoparticles and compositions comprising the albumin moiety. The invention is particularly applicable to pharmaceuticals. Some pharmaceuticals benefit from a long half-life, e.g. to increase dosage intervals. Some pharmaceuticals benefit from a short plasma half-life, e.g. to accelerate clearance from the body of a patient. Therefore, use of an albumin moiety according to the invention in pharmaceuticals allows the half-life of the pharmaceutical to be tailored as desired.

DEFINITIONS

Variant: The term "variant" means a polypeptide derived from a parent albumin by one or more (several) alteration(s), i.e., a substitution, insertion, and/or deletion, at one or more (several) positions. A substitution means a replacement of an amino acid occupying a position with a different amino acid; a deletion means removal of an amino acid occupying a position; and an insertion means adding 1 or more, such as 1, 2, 3, 4, 5, 6, 7, 8, 9 or 10, preferably 1-3 amino acids immediately adjacent an amino acid occupying a position. In relation to substitutions, 'immediately adjacent' may be to the N-side ('upstream') or C-side ('downstream') of the amino acid occupying a position ('the named amino acid'). Therefore, for an amino acid named/numbered 'X', the insertion may be at position 'X+1' ('downstream') or at position 'X−1' ('upstream').

Mutant: The term "mutant" means a polynucleotide encoding a variant.

Wild-Type Albumin: The term "wild-type" (WT) albumin means albumin having the same amino acid sequence as naturally found in an animal or in a human being.

FcRn and shFcRn: The term "FcRn" means the human neonatal Fc receptor (FcRn). shFcRn is a soluble recombinant form of FcRn. hFcRn is a heterodimer of SEQ ID NO: 30 (truncated heavy chain of the major histocompatibility complex class I-like Fc receptor (FCGRT)) and SEQ ID NO: 31 (beta-2-microglobulin). Together, SEQ ID NO: 30 and 31 form hFcRn.

smFcRn: The term "smFcRn" is a soluble recombinant form of the mouse neonatal Fc Receptor.

Isolated variant: The term "isolated variant" means a variant that is modified by the hand of man and separated completely or partially from at least one component with which it naturally occurs. The variant may be at least 1% pure, e.g., at least 5% pure, at least 10% pure, at least 20% pure, at least 40% pure, at least 60% pure, at least 80% pure, and at least 90% pure, as determined by SDS-PAGE or GP-HPLC.

Substantially pure variant: The term "substantially pure variant" means a preparation that contains at most 10%, at most 8%, at most 6%, at most 5%, at most 4%, at most 3%, at most 2%, at most 1%, and at most 0.5% by weight of other polypeptide material with which it is natively or recombinantly associated. Preferably, the variant is at least 92% pure, e.g., at least 94% pure, at least 95% pure, at least 96% pure, at least 97% pure, at least 98% pure, at least 99%, at least 99.5% pure, and 100% pure by weight of the total polypeptide material present in the preparation. The variants of the invention are preferably in a substantially pure form. This can be accomplished, for example, by preparing the variant by well-known recombinant methods and by purification methods.

Mature polypeptide: The term "mature polypeptide" means a polypeptide in its final form following translation and any post-translational modifications, such as N-terminal processing, C-terminal truncation, glycosylation, phosphorylation, etc. The mature polypeptide may be amino acids 1 to 585 of SEQ ID NO: 2, with the inclusion of any post-translational modifications.

Mature polypeptide coding sequence: The term "mature polypeptide coding sequence" means a polynucleotide that encodes a mature albumin polypeptide. The mature polypeptide coding sequence may be nucleotides 1 to 1758 of SEQ ID NO: 1.

Sequence Identity: The relatedness between two amino acid sequences or between two nucleotide sequences is described by the parameter "sequence identity".

For purposes of the invention, the degree of sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 3.0.0 or later. The optional parameters used are gap open penalty of 10, gap extension penalty of 0.5, and the EBLOSUM62 (EMBOSS version of BLOSUM62) substitution matrix. The output of Needle labelled "longest identity" (obtained using the -nobrief option) is used as the percent identity and is calculated as follows:

(Identical Residues×100)/(Length of Alignment−Total Number of Gaps in Alignment)

For purposes of the invention, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. The optional parameters used are gap open penalty of 10, gap extension penalty of 0.5, and the EDNAFULL (EMBOSS version of NCBI NUC4.4) substitution matrix. The output of Needle labeled "longest identity" (obtained using the -nobrief option) is used as the percent identity and is calculated as follows:

(Identical Deoxyribonucleotides×100)/(Length of Alignment−Total Number of Gaps in Alignment)

Fragment: The term "fragment" means a polypeptide having one or more (several) amino acids deleted from the amino and/or carboxyl terminus of an albumin and/or an internal region of albumin that has retained the ability to bind to FcRn. Fragments may consist of one uninterrupted sequence derived from HSA or it may comprise two or more (several) sequences derived from HSA. The fragments according to the invention have a size of more than approximately 20 amino acid residues, preferably more than 30 amino acid residues, more preferred more than 40 amino acid residues, more preferred more than 50 amino acid residues, more preferred more than 75 amino acid residues, more preferred more than 100 amino acid residues, more preferred more than 200 amino acid residues, more preferred more than 300 amino acid residues, even more preferred more than 400 amino acid residues and most preferred more than 500 amino acid residues. A fragment may comprise or consist of one more domains of albumin such as DI+DII, DI+DIII, DII+DIII, DIII+DIII, DI+DIII+DIII, DIII+DIII+DIII, or fragments of such domains or combinations of domains.

Domains I, II and III may be defined with reference to HSA (SEQ ID NO: 2). For example, HSA domain I may consist of or comprise amino acids 1 to 194 (±1 to 15 amino acids) of SEQ ID NO: 2, HSA domain II may consist of or comprise amino acids 192 (±1 to 15 amino acids) to 387 (±1 to 15 amino acids) of SEQ ID NO: 2 and domain III may consist of or comprise amino acid residues 381 (±1 to 15 amino acids) to 585 (±1 to 15 amino acids) of SEQ ID NO: 2. "±1 to 15 amino acids" means that the residue number may deviate by 1, 2, 3, 4, 5, 6, 7, 8, 9, 10, 11, 12, 13, 14, or 15 amino acids to the C-terminus and/or to the N-terminus of the stated amino acid position. Examples of domains I, II and III are described by Dockal et al (The Journal of Biological Chemistry, 1999, Vol. 274 (41): 29303-29310) and Kjeldsen et al (Protein Expression and Purification, 1998, Vol 13: 163-169) and are tabulated below.

| Amino acid residues of HSA domains I, II and III with reference to SEQ ID NO: 2 | Dockal et al | Kjeldsen et al |
|---|---|---|
| Domain I | 1 to 197 | 1 to 192 |
| Domain II | 189 to 385 | 193 to 382 |
| Domain III | 381 to 585 | 383 to 585 |

The skilled person can identify domains I, II and III in non-human albumins by amino acid sequence alignment with HSA, for example using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 3.0.0 or later. The optional parameters used are gap open penalty of 10, gap extension penalty of 0.5, and the EBLOSUM62 (EMBOSS version of BLOSUM62) substitution matrix. Other suitable software includes MUSCLE ((Multiple sequence comparison by log-expectation, Robert C. Edgar, Version 3.6, http://www.drive5.com/muscle; Edgar (2004) Nucleic Acids Research 32 (5), 1792-97 and Edgar (2004) BMC Bioinformatics, 5 (1):113) which may be used with the default settings as described in the User Guide (Version 3.6, September 2005). Versions of MUSCLE later than 3.6 may also be used for any aspect of the invention). Examples of suitable alignments are provided in FIGS. 1 and 2.

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Coding sequence: The term "coding sequence" means a polynucleotide, which directly specifies the amino acid sequence of its translated polypeptide product. The boundaries of the coding sequence are generally determined by an open reading frame, which usually begins with the ATG start codon or alternative start codons such as GTG and TTG and ends with a stop codon such as TAA, TAG, and TGA. The coding sequence may be a DNA, cDNA, synthetic, or recombinant polynucleotide.

cDNA: The term "cDNA" means a DNA molecule that can be prepared by reverse transcription from a mature, spliced, mRNA molecule obtained from a eukaryotic cell. cDNA lacks intron sequences that may be present in the corresponding genomic DNA. The initial, primary RNA transcript is a precursor to mRNA that is processed through a series of steps, including splicing, before appearing as mature spliced mRNA.

Nucleic acid construct: The term "nucleic acid construct" means a nucleic acid molecule, either single- or double-stranded, which is isolated from a naturally occurring gene or is modified to contain segments of nucleic acids in a manner that would not otherwise exist in nature or which is synthetic. The term nucleic acid construct is synonymous with the term "expression cassette" when the nucleic acid construct contains the control sequences required for expression of a coding sequence of the invention.

Control sequences: The term "control sequences" means all components necessary for the expression of a polynucleotide encoding a variant of the invention. Each control sequence may be native or foreign to the polynucleotide encoding the variant or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences within the coding region of the polynucleotide encoding a variant.

Operably linked: The term "operably linked" means a configuration in which a control sequence is placed at an appropriate position relative to the coding sequence of a polynucleotide such that the control sequence directs the expression of the coding sequence.

Expression: The term "expression" includes any step involved in the production of the variant including, but not limited to, transcription, post-transcriptional modification, translation, post-translational modification, and secretion.

Expression vector: The term "expression vector" means a linear or circular DNA molecule that comprises a polynucleotide encoding a variant and is operably linked to additional nucleotides that provide for its expression.

Host cell: The term "host cell" means any cell type that is susceptible to transformation, transfection, transduction, and the like with a nucleic acid construct or expression vector comprising a polynucleotide of the invention. The term "host cell" encompasses any progeny of a parent cell that is not identical to the parent cell due to mutations that occur during replication.

Plasma half-life: Plasma half-life is ideally determined in vivo in suitable individuals. However, since it is time consuming and expensive and there inevitable are ethical concerns connected with doing experiments in animals or man it is desirable to use an in vitro assay for determining whether plasma half-life is extended or reduced. It is known that the binding of albumin to its receptor FcRn is important for plasma half-life and the correlation between receptor binding and plasma half-life is that a higher affinity of albumin to its receptor leads to longer plasma half-life. Thus for the invention a higher affinity of albumin to FcRn is considered indicative of an increased plasma half-life and a lower affinity of albumin to its receptor is considered indicative of a reduced plasma half-life.

In this application and claims the binding of albumin to its receptor FcRn is described using the term affinity and the expressions "stronger" or "weaker". Thus, it should be understood that a molecule having a higher affinity to FcRn than HSA is considered to bind stronger to FcRn than HSA and a molecule having a lower affinity to FcRn than HSA is considered to bind weaker to FcRn than HSA.

The terms "longer plasma half-life" or "shorter plasma half-life" and similar expressions are understood to be in relationship to the corresponding parent or reference or corresponding albumin molecule. Thus, a longer plasma half-life with respect to a variant albumin of the invention means that the variant has longer plasma half-life than the corresponding albumin having the same sequences except for the alteration(s) described herein, e.g. at one or more (several) positions corresponding to 30 to 41, 75 to 91, 104 to 120, 144 to 150, 186 to 201, 414 to 426, 457 to 472, 492 to 538, 550 to 585, 276, 410, and/or 411 of the mature polypeptide of SEQ ID NO: 2, wherein, it is preferred that, when the variant, fragment or fusion polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly an alteration of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585, or from residue 497 (or equivalent position, relative to SEQ ID NO: 2) to the last residue of the mature sequence of the albumin. Introduction of a stop mutation may be instead of or together with the one or more (several) alterations mentioned herein.

Reference: a reference is an albumin, fusion, conjugate, composition, associate or nanoparticle to which an albumin variant, fusion, conjugate, composition, associate or nanoparticle is compared. The reference may comprise or consist of full length albumin (such as HSA or a natural allele thereof) of a fragment thereof. A reference may also be referred to as a 'corresponding' albumin, fusion, conjugate, composition, associate or nanoparticle to which an albumin variant, fusion, conjugate, composition, associate or nanoparticle. A reference may comprise or consist of HSA (SEQ ID NO: 2) or a fragment, fusion, conjugate, associate, nanoparticle or microparticle thereof. Preferably, the reference is identical to the polypeptide, fusion polypeptide, conjugate, composition, associate, nanoparticle or microparticle according to the invention ("being studied") with the exception of the albumin moiety. Preferably the albumin moiety of the reference comprises or consists of an albumin (e.g. HSA, SEQ ID NO: 2) or a fragment thereof. The amino acid sequence of the albumin moiety of the reference may be longer than, shorter than or, preferably, the same (±1 to 15 amino acids) length as the amino sequence of the albumin moiety of the polypeptide, fusion polypeptide, conjugate, composition, associate, nanoparticle or microparticle according to the invention ("being studied").

Figure 1:
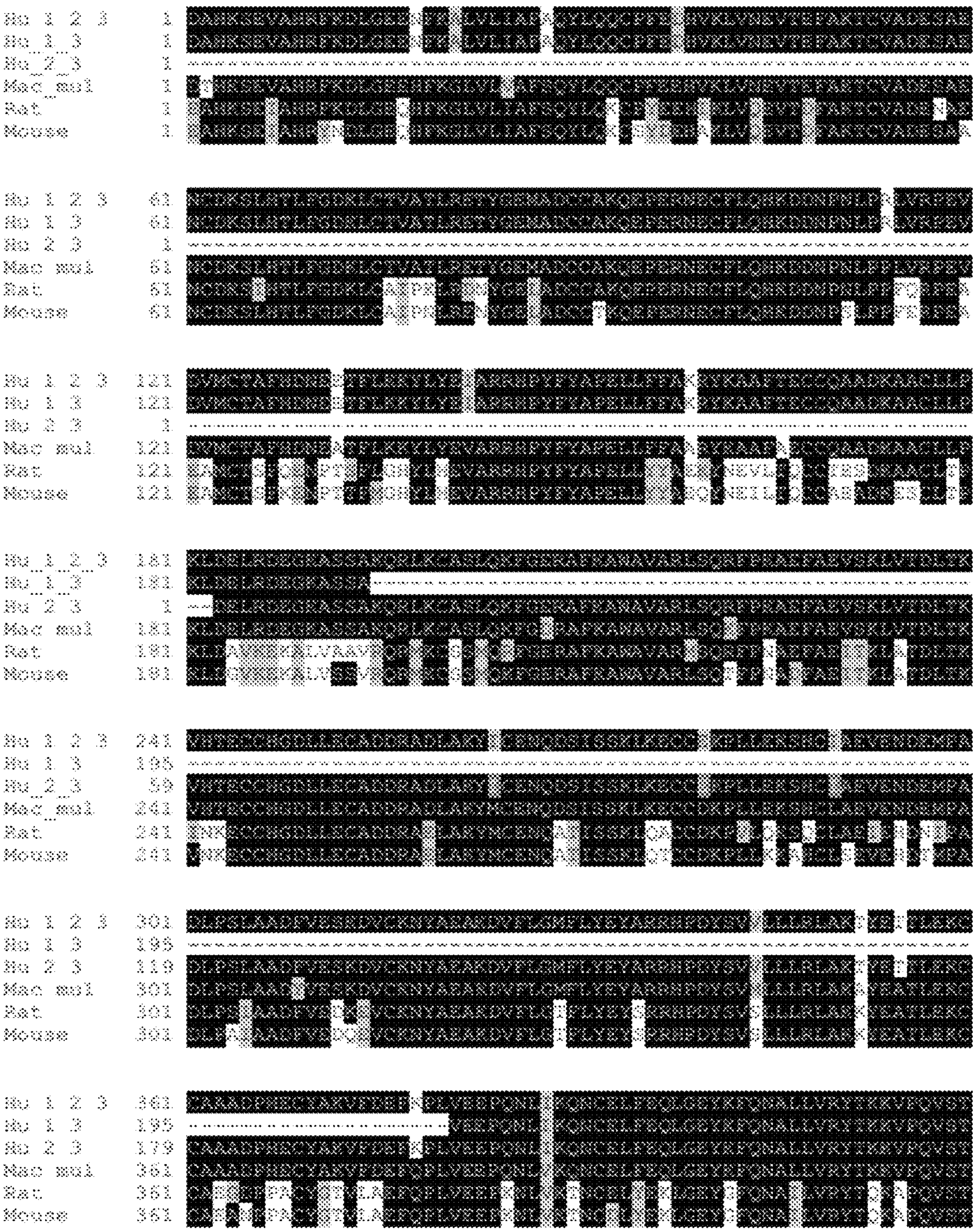
FIG. 1: Multiple alignment of amino acid sequences of (i) full length mature HSA (Hu_1_2_3), (ii) an albumin variant comprising domain I and domain III of HSA (Hu_1_3), (iii) an albumin variant comprising domain II and domain III of HSA (Hu_2_3), (iv) full-length *Macaca mulatta* albumin (Mac_mul), (v) full-length *Rattus norvegicus* albumin (Rat) and (vi) full-length *Mus musculus* albumin (Mouse). Positions 500, 550 and 573 (relative to full length HSA) are indicated by arrows.
Figure 1:
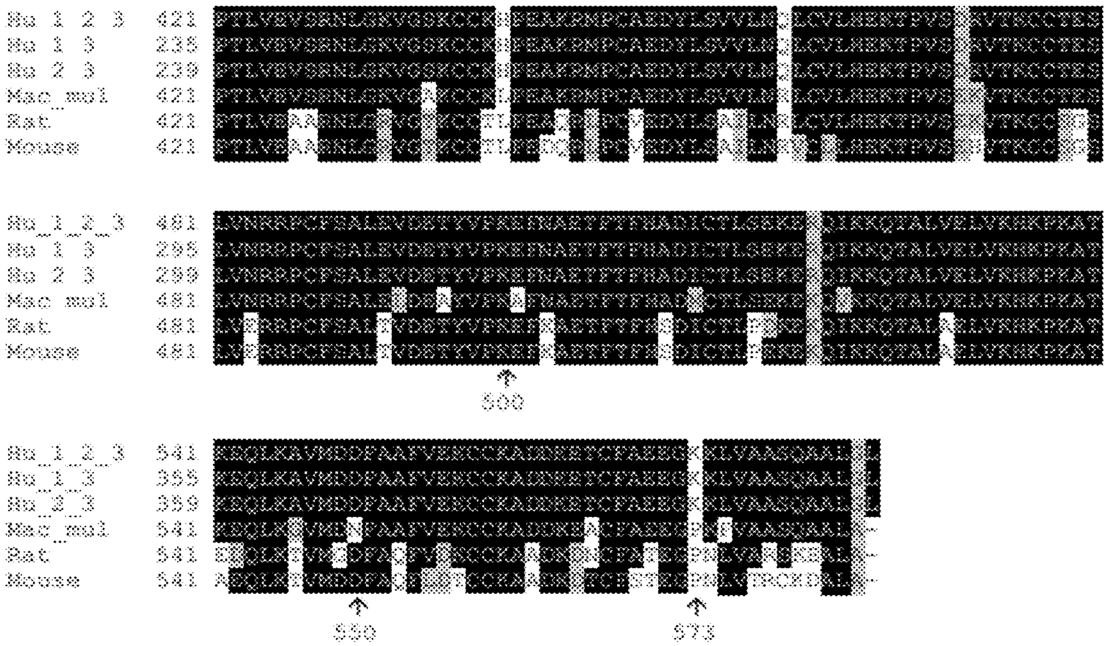

Equivalent amino acid positions: Throughout this specification amino acid positions are defined in relation to full-length mature human serum albumin (i.e. without leader sequence, SEQ ID NO: 2). However, the skilled person understands that the invention also relates to variants of non-human albumins e.g. those disclosed herein) and/or fragments of a human or non-human albumin. Equivalent positions can be identified in fragments of human serum albumin, in animal albumins and in fragments, fusions and other derivative or variants thereof by comparing amino acid sequences using pairwise (e.g. ClustalW) or multiple (e.g. MUSCLE) alignments. For example, FIG. 1 shows that positions equivalent to 500, 550 and 573 in full length human serum albumin are easily identified in fragments of human serum albumin and in albumins of other species. Positions 500, 550 and 573 are indicated by arrows. Further details are provided in Table 1 below.

TABLE 1

Example of identification of equivalent positions in HSA, animal albumins and albumin fragments

| Organism (accession number of protein) | Albumin: Full length or fragment | Albumin: Fragment details | Albumin: Total length of mature protein | Position equivalent to human serum albumin (native amino acid): 500 (K) | 550 (D) | 573 (K) |
|---|---|---|---|---|---|---|
| *Homo sapiens* (AAA98797) | Full length | — | 585 | 500 (K) | 550 (D) | 573 (K) |
| *Homo sapiens* | Fragment | DI, DIII | 399 | 314 (K) | 364 (D) | 387 (K) |
| *Homo sapiens* | Fragment | DI, DIII | 403 | 318 (K) | 368 (D) | 391 (K) |
| *Macaca mulatta* (NP_001182578) | Full length | — | 584 | 500 (K) | 550 (N) | 573 (P) |
| *Rattus norvegicus* (AAH85359) | Full length | — | 584 | 500 (K) | 550 (D) | 573 (P) |
| *Mus musculus* (AAH49971) | Full length | — | 584 | 500 (K) | 550 (D) | 573 (P) |

FIG. 1 was generated by MUSCLE using the default parameters including output in ClustalW 1.81 format. The raw output data was shaded using BoxShade 3.21 (http://www.ch.embnet.org/software/BOX_form.html) using Output Format: RTF_new; Font Size: 10; Consensus Line: no consensus line; Fraction of sequences (that must agree for shading): 0.5; Input sequence format: ALN. Therefore, throughout this specification amino acid positions defined in human serum albumin also apply to equivalent positions in fragments, derivatives or variants and fusions of human serum albumin, animals from other species and fragments and fusions thereof. Such equivalent positions may have (i) a different residue number in its native protein and/or (ii) a different native amino acid in its native protein.

Figure 2:
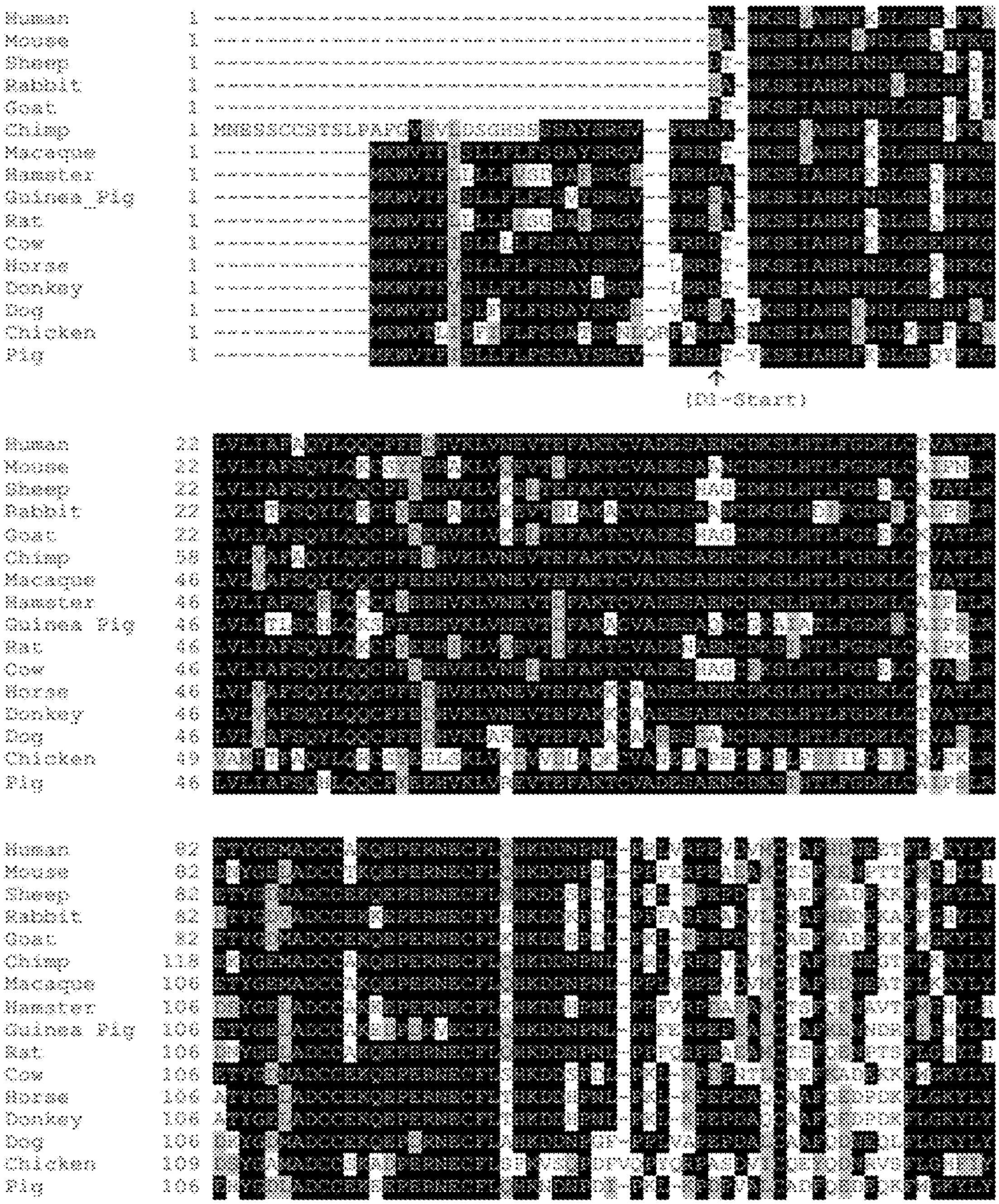
FIG. 2: Multiple alignment of amino acid sequence of mature albumin from human, sheep, mouse, rabbit and goat and immature albumins from chimpanzee ("Chimp"), macaque, hamster, guinea pig, rat, cow, horse, donkey, dog, chicken, and pig. The Start and End amino acids of domains 1, 2 and 3 (as defined by Dockal et al (The Journal of Biological Chemistry, 1999, Vol. 274 (41): 29303-29310)) are indicated with respect to mature human albumin.
Figure 2:
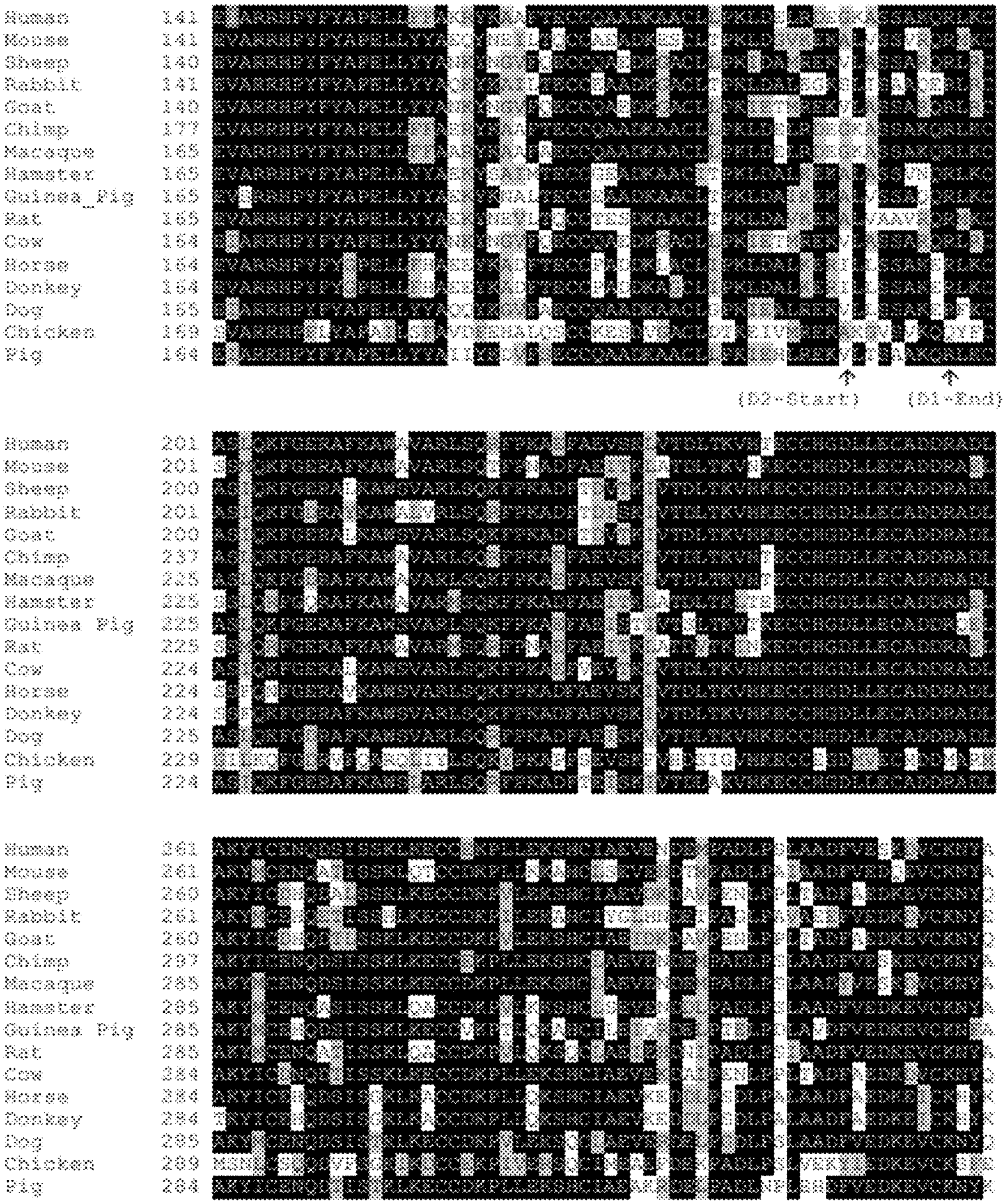
Figure 2:
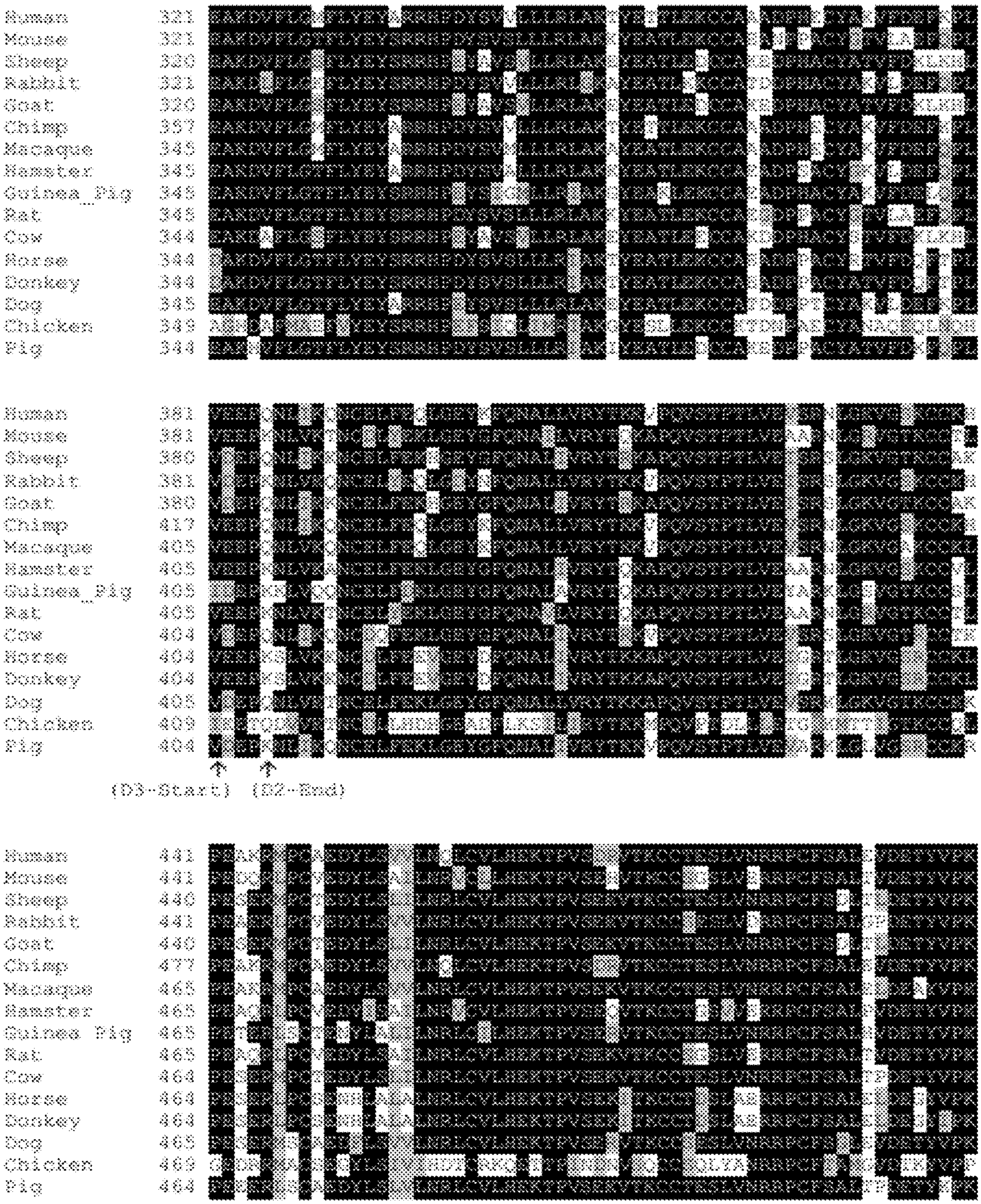
Figure 2:
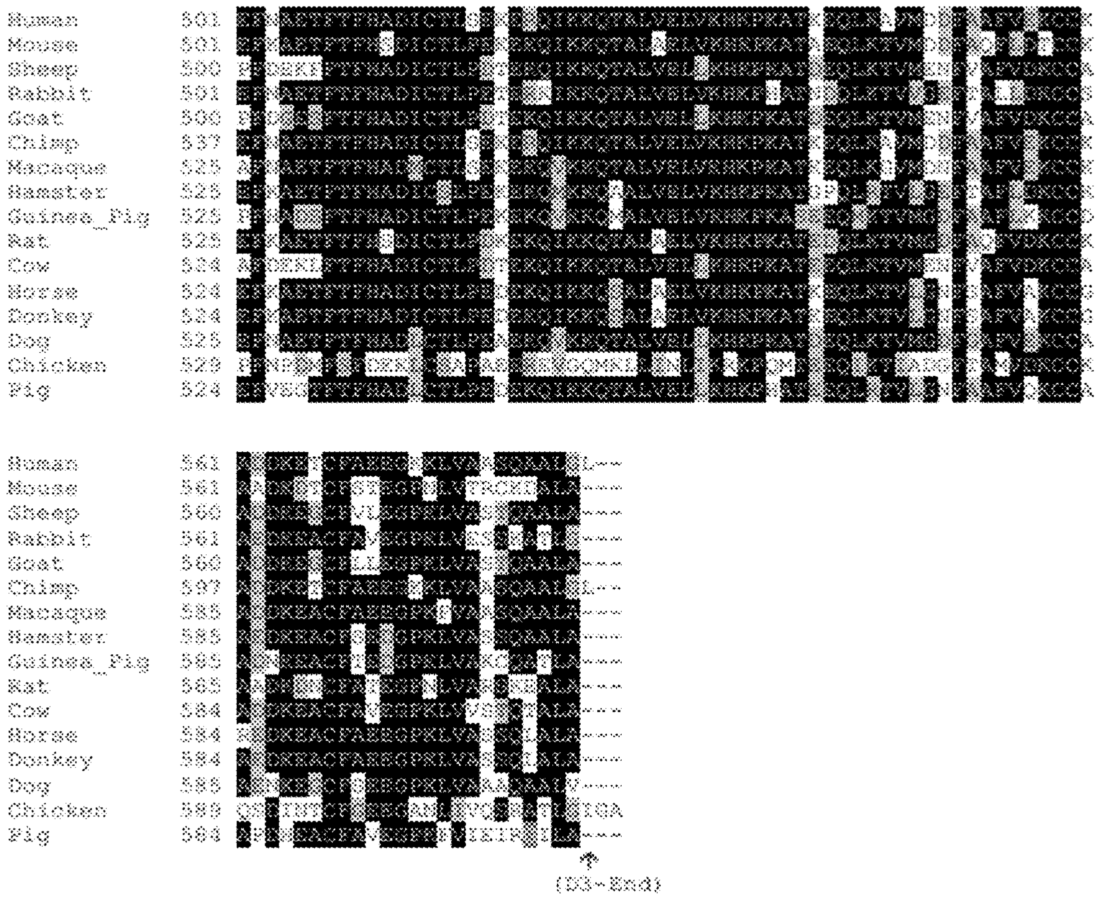

Likewise, FIG. 2 shows that equivalent positions can be identified in fragments (e.g. domains) of an albumin with reference to SEQ ID NO: 2 (HSA).

Conventions for Designation of Variants

For purposes of the invention, the mature polypeptide disclosed in SEQ ID NO: 2 is used to determine the corresponding amino acid residue in another albumin. The amino acid sequence of another albumin is aligned with the mature polypeptide disclosed in SEQ ID NO: 2, and based on the alignment, the amino acid position number corresponding to any amino acid residue in the mature polypeptide disclosed in SEQ ID NO: 2 is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 3.0.0 or later.

Identification of the corresponding amino acid residue in another albumin can be confirmed by an alignment of multiple polypeptide sequences using "ClustalW" (Larkin et al., 2007, *Bioinformatics* 23: 2947-2948).

When the other polypeptide (or protein) has diverged from the mature polypeptide of SEQ ID NO: 2 such that traditional sequence-based comparison fails to detect their relationship (Lindahl and Elofsson, 2000, *J. Mol. Biol.* 295: 613-615), other pairwise sequence comparison algorithms can be used. Greater sensitivity in sequence-based searching can be attained using search programs that utilize probabilistic representations of polypeptide families (profiles) to search databases. For example, the PSI-BLAST program generates profiles through an iterative database search process and is capable of detecting remote homologs (Atschul et al., 1997, *Nucleic Acids Res.* 25: 3389-3402). Even greater sensitivity can be achieved if the family or superfamily for the polypeptide has one or more representatives in the protein structure databases. Programs such as GenTHREADER (Jones, 1999, *J. Mol. Biol.* 287: 797-815; McGuffin and Jones, 2003, *Bioinformatics* 19: 874-881) utilize information from a variety of sources (PSI-BLAST, secondary structure prediction, structural alignment profiles, and solvation potentials) as inputs to a neural network that predicts the structural fold for a query sequence. Similarly, the method of Gough et al., 2000, *J. Mol. Biol.* 313: 903-919, can be used to align a sequence of unknown structure within the superfamily models present in the SCOP database. These alignments can in turn be used to generate homology models for the polypeptide, and such models can be assessed for accuracy using a variety of tools developed for that purpose.

For proteins of known structure, several tools and resources are available for retrieving and generating structural alignments. For example the SCOP superfamilies of proteins have been structurally aligned, and those alignments are accessible and downloadable. Two or more protein structures can be aligned using a variety of algorithms such as the distance alignment matrix (Holm and Sander, 1998, *Proteins* 33: 88-96) or combinatorial extension (Shindyalov and Bourne, 1998, *Protein Engineering* 11: 739-747), and implementations of these algorithms can additionally be utilized to query structure databases with a structure of interest in order to discover possible structural homologs (e.g., Holm and Park, 2000, *Bioinformatics* 16: 566-567).

In describing the albumin variants of the invention, the nomenclature described below is adapted for ease of reference. The accepted IUPAC single letter or three letter amino acid abbreviation is employed. The term 'point mutation' and/or 'alteration' includes deletions, insertions and substitutions.

Substitutions. For an amino acid substitution, the following nomenclature is used: Original amino acid, position, substituted amino acid. Accordingly, for example the substitution of threonine with alanine at position 226 is designated as "Thr226Ala" or "T226A". Multiple mutations (or alterations) are separated by addition marks ("+"), e.g., "Gly205Arg+Ser411Phe" or "G205R+S411F", representing substitutions at positions 205 and 411 of glycine (G) with arginine (R) and serine (S) with phenylalanine (F), respectively. The Figures also use ("/"), e.g., "E492T/N503D" this should be viewed as interchangeable with ("+").

Deletions. For an amino acid deletion, the following nomenclature is used: Original amino acid, position*. Accordingly, the deletion of glycine at position 195 is designated as "Gly195*" or "G195*". Multiple deletions are separated by addition marks ("+"), e.g., "Gly195*+Ser411*" or "G195*+S411*".

Insertions. As disclosed above, an insertion may be to the N-side ('upstream', 'X−1') or C-side ('downstream', 'X+1') of the amino acid occupying a position ('the named (or original) amino acid', 'X').

For an amino acid insertion to the C-side ('downstream', 'X+1') of the original amino acid ('X'), the following nomenclature is used: Original amino acid, position, original amino acid, inserted amino acid. Accordingly the insertion of lysine after glycine at position 195 is designated "Gly195GlyLys" or "G195GK". An insertion of multiple amino acids is designated [Original amino acid, position, original amino acid, inserted amino acid #1, inserted amino acid #2; etc.]. For example, the insertion of lysine and alanine after glycine at position 195 is indicated as "Gly195GlyLysAla" or "G195GKA".

In such cases the inserted amino acid residue(s) are numbered by the addition of lower case letters to the position number of the amino acid residue preceding the inserted amino acid residue(s). In the above example, the sequence would thus be:

| Parent: | Variant: |
|---|---|
| 195<br>G | 195 195a 195b<br>G - K - A |

For an amino acid insertion to the N-side ('upstream', 'X−1') of the original amino acid (X), the following nomenclature is used: Original amino acid, position, inserted amino acid, original amino acid. Accordingly the insertion of lysine (K) before glycine (G) at position 195 is designated "Gly195LysGly" or "G195KG". An insertion of multiple amino acids is designated [Original amino acid, position, inserted amino acid #1, inserted amino acid #2; etc., original amino acid]. For example, the insertion of lysine (K) and alanine (A) before glycine at position 195 is indicated as "Gly195LysAlaGly" or "G195KAG". In such cases the inserted amino acid residue(s) are numbered by the addition of lower case letters with prime to the position number of the amino acid residue following the inserted amino acid residue(s). In the above example, the sequence would thus be:

| Parent: | Variant: |
|---|---|
| 195<br>G | 195a' 195b' 195<br>K - A - G |

Multiple alterations. Variants comprising multiple alterations are separated by addition marks ("+"), e.g., "Arg170Tyr+Gly195Glu" or "R170Y+G195E" representing a substitution of tyrosine and glutamic acid for arginine and glycine at positions 170 and 195, respectively.

Different substitutions. Where different substitutions can be introduced at a position, the different substitutions are separated by a comma, e.g., "Arg170Tyr,Glu" represents a substitution of arginine with tyrosine or glutamic acid at position 170. Thus, "Tyr167Gly,Ala+Arg170Gly,Ala" designates the following variants: "Tyr167Gly+Arg170Gly", "Tyr167Gly+Arg170Ala", "Tyr167Ala+Arg170Gly", and "Tyr167Ala+Arg170Ala".

Parent Albumin

Albumins are proteins and constitute the most abundant protein in plasma in mammals and albumins from a long number of mammals have been characterized by biochemical methods and/or by sequence information. Several albumins, e.g., human serum albumin (HSA), have also been characterized crystallographically and the structure determined (HSA: He X M, Carter D C (July 1992). "Atomic structure and chemistry of human serum albumin". Nature 358 (6383): 209-15; horse albumin: Ho, J. X. et al. (2001). X-ray and primary structure of horse serum albumin (*Equus caballus*) at 0.27-nm resolution. Eur J. Biochem. 215 (1):205-12).

The term "parent" or "parent albumin" means an albumin to which an alteration is made by the hand of man to produce the albumin variants of the invention. The parent may be a naturally occurring (wild-type) polypeptide or an allele thereof, or even a variant thereof.

The term "albumin" means a protein having the same and/or very similar three dimensional structure as HSA or HSA domains and has similar properties. Similar three dimensional structures are for example the structures of the albumins from the species mentioned under parent albumin. Some of the major properties of albumin is its ability to regulate of plasma volume since it contributes to 85% of the osmotic effect of normal plasma, a long plasma half-life of around 19 days±5 days, ligand-binding, e.g. binding of endogenous molecules such as acidic, lipophilic compounds including bilirubin, fatty acids, hemin and thyroxine (see also Table 1 of Kragh-Hansen et al, 2002, Biol. Pharm. Bull. 25, 695, hereby incorporated by reference), binding of small organic compounds with acidic or electronegative features e.g. drugs such as warfarin, diazepam, ibuprofen and paclitaxel (see also Table 1 of Kragh-Hansen et al, 2002, Biol. Pharm. Bull. 25, 695, hereby incorporated by reference). Not all of these properties need to be fulfilled to in order to characterize a protein or fragment as an albumin.

HSA is a preferred albumin according to the invention and is a protein consisting of 585 amino acid residues and has a molecular weight of 67 kDa. In its natural form it is not glycosylated. The amino acid sequence of HSA is shown in SEQ ID NO: 2. The skilled person will appreciate that natural alleles may exist having essentially the same properties as HSA but having one or more amino acid changes compared to SEQ ID NO: 2, and the inventors also contemplate the use of such natural alleles as parent albumin according to the invention.

Albumins have generally a long plasma half-life of approximately 20 days or longer, e.g., HSA has a plasma half-life of 19 days. It is known that the long plasma half-life of HSA is mediated via interaction with its receptor FcRn, however, an understanding or knowledge of the exact mechanism behind the long half-life of HSA is not essential for the invention.

According to the invention the term “albumin” means a protein having the same, or very similar three dimensional structure as HSA and having a long plasma half-life. As examples of albumin proteins according to the invention can be mentioned human serum albumin (e.g. AAA98797 or P02768-1, SEQ ID NO: 2 (mature), SEQ ID NO: 4 (immature)), primate serum albumin, (such as chimpanzee serum albumin (e.g. predicted sequence XP_517233.2 SEQ ID NO: 5), gorilla serum albumin or macaque serum albumin (e.g. NP_001182578, SEQ ID NO: 6), rodent serum albumin (such as hamster serum albumin (e.g. A6YF56, SEQ ID NO: 7), guinea pig serum albumin (e.g. Q6WDN9-1, SEQ ID NO: 8), mouse serum albumin (e.g. AAH49971 or P07724-1 Version 3, SEQ ID NO: 9) and rat serum albumin (e.g. AAH85359 or P02770-1 Version 2, SEQ ID NO: 10))), bovine serum albumin (e.g. cow serum albumin P02769-1, SEQ ID NO: 11), equine serum albumin such as horse serum albumin (e.g. P35747-1, SEQ ID NO: 12) or donkey serum albumin (e.g. Q5XLE4-1, SEQ ID NO: 13), rabbit serum albumin (e.g. P49065-1 Version 2, SEQ ID NO: 14), goat serum albumin (e.g. ACF10391, SEQ ID NO: 15), sheep serum albumin (e.g. P14639-1, SEQ ID NO: 16), dog serum albumin (e.g. P49822-1, SEQ ID NO: 17), chicken serum albumin (e.g. P19121-1 Version 2, SEQ ID NO: 18) and pig serum albumin (e.g. P08835-1 Version 2, SEQ ID NO: 19) or a polypeptide having at least 70, 75, 80, 85, 90, 91, 92, 93, 94, 95, 96, 97, 98 or at least 99% amino acid identity to such an albumin. The parent or reference albumin may be an artificial variant such as HSA K573P (SEQ ID NO: 3) or a chimeric albumin such as the N-terminal of HSA and the C-terminal of *macaca* albumin (SEQ ID NO: 20), N-terminal of HSA and the C-terminal of mouse albumin (SEQ ID NO: 21), N-terminal of HSA and the C-terminal of rabbit albumin (SEQ ID NO: 22), N-terminal of HSA and the C-terminal of sheep albumin (SEQ ID NO: 23).

Other examples of albumin, which are also included in the scope of this application, include ovalbumin (e.g. P01012.pro: chicken ovalbumin; O73860.pro: turkey ovalbumin). HSA as disclosed in SEQ ID NO: 2 or any naturally occurring allele thereof, is the preferred albumin according to the invention.

The parent albumin, a fragment thereof, or albumin part of a fusion polypeptide comprising albumin or a fragment thereof according to the invention has generally a sequence identity to the sequence of HSA shown in SEQ ID NO: 2 of at least 60%, preferably at least 70%, preferably at least 80%, preferably at least 85%, preferably at least 86%, preferably at least 87%, preferably at least 88%, preferably at least 89%, preferably at least 90%, preferably at least 91%, preferably at least 92%, preferably at least 93%, preferably at least 94%, preferably at least 95%, more preferred at least 96%, more preferred at least 97%, more preferred at least 98% and most preferred at least 99%. The sequence identity may be over the full-length of SEQ ID NO: 2 or over a molecule consisting or comprising of a fragment such as one or more domains of SEQ ID NO: 2 such as a molecule consisting of or comprising domain III (e.g. SEQ ID NO: 27), a molecule consisting of or comprising domain II and domain III (e.g. SEQ ID NO: 25), a molecule consisting of or comprising domain I and domain III (e.g. SEQ ID NO: 24), a molecule consisting of or comprising two copies of domain III (e.g. SEQ ID NO: 26), a molecule consisting of or comprising three copies of domain III (e.g. SEQ ID NO: 28) or a molecule consisting of or comprising domain I and two copies of domain III (e.g. SEQ ID NO: 29).

The parent preferably comprises or consists of the amino acid sequence of SEQ ID NO: 4. The parent may comprise or consist of the mature polypeptide of SEQ ID NO: 2.

In another embodiment, the parent is an allelic variant of the mature polypeptide of SEQ ID NO: 2.

The parent albumin many be encoded by a polynucleotide that hybridizes under very low stringency conditions, low stringency conditions, medium stringency conditions, medium-high stringency conditions, high stringency conditions, or very high stringency conditions with (i) the mature polypeptide coding sequence of SEQ ID NO: 1, (ii) the mature polypeptide coding sequence of SEQ ID NO: 1, or (iii) the full-length complementary strand of (i) or (ii) (J. Sambrook, E. F. Fritsch, and T. Maniatis, 1989, *Molecular Cloning, A Laboratory Manual,* 2d edition, Cold Spring Harbor, N.Y.).

The polynucleotide of SEQ ID NO: 1 or a subsequence thereof, as well as the amino acid sequence of SEQ ID NO: 2 or a fragment thereof, may be used to design nucleic acid probes to identify and clone DNA encoding a parent from strains of different genera or species according to methods well known in the art. In particular, such probes can be used for hybridization with the genomic or cDNA of the genus or species of interest, following standard Southern blotting procedures, in order to identify and isolate the corresponding gene therein. Such probes can be considerably shorter than the entire sequence, but should be at least 14, e.g., at least 25, at least 35, or at least 70 nucleotides in length. Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labelled for detecting the corresponding gene (for example, with $^{32}P$, $^{3}H$, $^{35}S$, biotin, or avidin). Such probes are encompassed by the invention.

A genomic DNA or cDNA library prepared from such other organisms may be screened for DNA that hybridizes with the probes described above and encodes a parent. Genomic or other DNA from such other organisms may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that is homologous with SEQ ID NO: 1 or a subsequence thereof, the carrier material is used in a Southern blot.

For purposes of the invention, hybridization indicates that the polynucleotide hybridizes to a labelled nucleotide probe corresponding to the polynucleotide shown in SEQ ID NO: 1, its complementary strand, or a subsequence thereof, under low to very high stringency conditions. Molecules to which the probe hybridizes can be detected using, for example, X-ray film or any other detection means known in the art.

The nucleic acid probe may comprise or consist of the mature polypeptide coding sequence of SEQ ID NO: 1, i.e. nucleotides 1 to 1785 of SEQ ID NO: 1. The nucleic acid probe may comprise or consist of a polynucleotide that encodes the polypeptide of SEQ ID NO: 2 or a fragment thereof.

For long probes of at least 100 nucleotides in length, very low to very high stringency conditions are defined as pre-hybridization and hybridization at 42° C. in 5×SSPE, 0.3% SDS, 200 micrograms/ml sheared and denatured salmon sperm DNA, and either 25% formamide for very low and low stringencies, 35% formamide for medium and medium-high stringencies, or 50% formamide for high and very high stringencies, following standard Southern blotting procedures for 12 to 24 hours optimally. The carrier material is finally washed three times each for 15 minutes using 2×SSC, 0.2% SDS at 45° C. (very low stringency), 50° C. (low stringency), 55° C. (medium stringency), 60° C. (medium-high stringency), 65° C. (high stringency), or 70° C. (very high stringency).

For short probes that are about 15 nucleotides to about 70 nucleotides in length, stringency conditions are defined as pre-hybridization and hybridization at about 5° C. to about 10° C. below the calculated $T_m$ using the calculation according to Bolton and McCarthy (1962, *Proc. Natl. Acad. Sci. USA* 48: 1390) in 0.9 M NaCl, 0.09 M Tris-HCl pH 7.6, 6 mM EDTA, 0.5% NP-40, 1×Denhardt's solution, 1 mM sodium pyrophosphate, 1 mM sodium monobasic phosphate, 0.1 mM ATP, and 0.2 mg of yeast RNA per ml following standard Southern blotting procedures for 12 to 24 hours optimally. The carrier material is finally washed once in 6×SCC plus 0.1% SDS for 15 minutes and twice each for 15 minutes using 6×SSC at 5° C. to 10° C. below the calculated $T_m$.

The parent may be encoded by a polynucleotide with a sequence identity to the mature polypeptide coding sequence of SEQ ID NO: 1 of at least 60%, e.g., at least 65%, at least 70%, at least 75%, at least 80%, at least 85%, at least 90%, at least 95%, at least 96%, at least 97%, at least 98%, at least 99%, or 100%, which encodes a polypeptide which is able to function as an albumin. In an embodiment, the parent is encoded by a polynucleotide comprising or consisting of SEQ ID NO: 1.

Albumin Moiety

The albumin part of a fusion polypeptide, conjugate, associate, nanoparticle or composition comprising the albumin variant or fragment thereof according to the invention, may be referred to as an 'albumin moiety' or 'albumin component'. A polypeptide according to the invention may comprise or consist of an albumin moiety.

Particular aspects of the invention are discussed below:

Preparation of Variants

A first aspect of the invention relates to a method for preparing a polypeptide which is a variant albumin, fragment thereof, or fusion polypeptide comprising variant albumin or a fragment thereof, preferably having a binding affinity to FcRn (preferably shFcRn) or half-life (e.g. in plasma) which is altered relative to a reference albumin, the method comprising the steps of:

a. Identifying one or more (several) amino acid residue positions being important for the binding of albumin to FcRn or half-life (e.g. in plasma), in an albumin or a fragment thereof or the albumin part of a fusion polypeptide comprising albumin or a fragment thereof;
b. Providing a nucleic acid encoding said albumin, the fragment thereof or the albumin part of a fusion polypeptide comprising albumin or the fragment thereof;
c. Modifying the nucleic acid provided in b., so that the one or more (several) amino acid residue located at the positions identified in a., there is an alteration such as a deletion, substitution or an insertion, most preferably a substitution;
d. Expressing the modified nucleic acid in a suitable host cell; and
e. Recovering the variant albumin, the fragment thereof or the fusion polypeptide comprising variant albumin or the fragment thereof.

The identification of one or more (several) amino acid residue positions being important for the binding of albumin to FcRn or half-life (e.g. in plasma), in albumin, fragment thereof or the albumin part of a fusion polypeptide can be done in several ways including, but not limited to, random mutagenesis followed by analysis of the generated mutants and comparison with the non-mutated parent or reference molecule, and identification based on structural considerations optionally followed by generation of variants having the identified alterations and comparison with the non-mutated patent molecule.

Reference albumins are disclosed herein, it is particularly preferred that the reference albumin is HSA (SEQ ID No: 2).

A preferred method for identification of one or more (several) amino acid residue positions to be changed to in order to prepare a variant HSA having an altered binding to FcRn or half-life (e.g. in plasma) compared with natural HSA, comprises the following steps:

i) providing a three dimensional structure (model) of an albumin, such as HSA;
ii) providing a three dimensional structure (model) of FcRn;
iii) using the albumin structure of (i) and the FcRn structure of (ii) to model the structure of the complex formed by albumin and FcRn when bound together, thus generating a 'docking model';
iv) using the docking model to identify amino acid residues in the albumin which interact with FcRn or are involved in the interaction with FcRn;

Step iii) and iv) can be done using techniques well known to the skilled person.

The docking model may be prepared using any suitable method or software. Suitable software includes fast fourier based software such as ZDOCK Fast Fourier Transform based protein docking program (Chen R et al (2003). *Proteins* 52 (1):80-87). With regards construction of a docking model for FcRn and albumin, it is preferred that the model of albumin comprises domain III and at least one of domain I or domain II, preferably all domains. Preferably the albumin is HSA (e.g. SEQ ID NO: 2). Preferably, the model of albumin is resolved at pH 7 to 8. The model of albumin may be, or be based on the crystal structure of HSA at 2.5 Å (PDB code 1bm0 (Sugio S et al (1999) *Protein Eng* 12 (6):439-446). Preferably the FcRn is a human FcRn and most preferably soluble human FcRn. It is preferred that the model of FcRn is solved at a pH lower than 6.4, for example at a pH equal to or lower than pH 6.3, 6.2, 6.1, 6, 5.9, 5.8, 5.7, 5.6, 5.5, 5.4, 5.3, 5.2, 5.1, 5.0, 4.9, 4.8, 4.7, 4.6, 4.5, 4.4, 4.3, 4.2, 4.1, 4.0, 3.9, 3.8, 3.7, 3.6, 3.5, 3.4, 3.3, 3.2, 3.1, 3.0. More preferably the pH is from 3.7 to 4.7, 4.0 to 4.4 and most preferably 4.2. An advantage of a low pH is that it is more representative of the natural physiological environment in which albumin and FcRn bind. The model of FcRn may be, or be based on, the 2.7 Å resolution structure of FcRn at pH 8.2 (PDB code 1exu).

A second FcRn model may be used in addition to the first FcRn model and it is preferred that the second model is solved at a different pH to the first model, e.g. a higher pH such as a pH equal to or higher than 6.4, 6.8, 7.0, 7.2, 7.4, 7.6, 7.8, 8.0, 8.2, 8.4, 8.6, 8.8 or 9.0. An advantage of using an additional FcRn model is that the impact of pH on binding between FcRn and an albumin moiety can be studied. Thus, docking models created using FcRns solved at different pHs may be compared to identify amino acid residues which are involved in albumin-FcRn binding at one pH but not the other, i.e. pH-dependent binding.

Identification of amino acid residues in the albumin which interact with FcRn or are involved in the interaction with FcRn may be done manually and/or visually Optionally, the method of preparing and/or method of identification may comprise comparing the primary structure and/or the tertiary structure of a second albumin (e.g. a non-human albumin) with the primary structure and/or the tertiary structure of the albumin of (i) to identify equivalent amino acids to those identified in (iv). Primary structure comparison may be done by sequence alignment between the second albumin and the albumin of (i). Secondary structure comparison may be done using publicly available software such as PDBeFold (also known as SSM), an interactive service for comparing protein structures in 3D (e.g. Version 2.36 or later, available at http://www.ebi.ac.uk/msd-srv/ssm/ and described in publications such as Krissinel et al (2004) Acta Cryst. D60, 2256-2268 and Krissinel (2007) Bioinformatics 23, 717-723).

Optionally, the method of preparing and/or method of identification may comprise preparing variants of albumin at the positions identified in (iv) or (v) and confirming (e.g. by binding affinity analysis) that the prepared variants have altered binding to FcRn compared to a reference such as the albumin of (i). Binding affinity analysis may be carried out by surface plasmon resonance (e.g. as disclosed herein) and/or by ELISA (e.g. as disclosed in WO2011/051489 (PCT/EP10/066,572), incorporated herein by reference) and/or confirming that the prepared variants have altered half-lives, e.g. in plasma, compared a reference such as the albumin of (i). However, the skilled person will appreciate that other methods may be used to identify polypeptides having different binding properties to FcRn than HSA, and that the method is not dependent on how the polypeptide, having different binding properties to FcRn, has been identified.

According to the first aspect of the invention, preferably the amino acid resides of albumin which affect the binding of the albumin to FcRn or half-life (e.g. in plasma) are located in one or more (several) of the following regions: (a) 505, 531, 524, 472, 108, 190, 197 and 425; (b) 492 to 538; (c) 186 to 201; (d) 457 to 472; (e) 414 to 426; (f) 104 to 120; (g) 75 to 91; (h) 144 to 150; (i) 30 to 41, (j) 550 to 585 and (k) 276, 410 and 414 with one or more (several) of A, C, D, E, F, G, H, I, K, L, M, N, P, Q, R, S, T, V, W, Y and/or a stop codon at a position from 497 to 585; wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, and/or (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or the group consisting of positions (iii) 82, 114, 119, 464, 201, 505, 510, 513, 533, 535, 536, 550, 560, 563, 565, 573, 574 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585 (positions are provided relative to SEQ ID NO: 2, however the invention also includes equivalent positions in sequences other than SEQ ID No: 2).

Furthermore introduction of a stop codon may be made at any of positions 497 to 585, i.e. any of positions 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, (or equivalent position, relative to SEQ ID NO: 2). The introduction may be made by insertion or substitution. Introduction of such a stop codon may be in addition to or instead of an alteration described herein.

Therefore, the first aspect of the invention provides an albumin variant or fragment thereof having altered binding affinity to FcRn compared with a parent or reference albumin, comprising an alteration (such as a substitution, deletion or insertion) at:

(a) one or more (several) positions corresponding to the following positions of SEQ ID No: 2: any of 30, 31, 32, 33, 35, 36, 37, 39, 41, 77, 78, 79, 81, 84, 85, 87, 88, 89, 105, 106, 107, 108, 109, 110, 111, 112, 117, 118, 120, 144, 145, 146, 147, 148, 149, 150, 186, 187, 188, 189, 190, 191, 192, 193, 194, 195, 196, 197; and/or (b) one or more (several) positions corresponding to the following positions of SEQ ID No: 2: any of 189, 190, 191, 192, 193, 194, 195, 196, 197, 198, 199; and/or (c) one or more (several) positions corresponding to the following positions of SEQ ID No: 2: 414, 415, 416, 418, 419, 420, 421, 422, 423, 424, 425, 426, 457, 458, 459, 460, 462, 463, 465, 466, 467, 468, 469, 470, 472, 497, 498, 502, 507, 508, 509, 511, 515, 516, 517, 518, 519, 520, 521, 522, 523, 524, 525, 526, 527, 528, 529, 530, 531, 532, 534, 551, 552, 553, 554, 555, 556, 557, 561, 566, 568, 569, 570, 571, 572, 576, 583 wherein the altered binding affinity of the variant or fragment thereof is relative to the binding affinity of a reference such as a parent albumin or fragment which does not comprise the alteration.

The positions described in (a) (above) may be in a first Domain (e.g. Domain I) of a polypeptide such as an albumin, e.g. HSA. The positions described in (b) (above) may be in a second Domain (e.g. Domain II) of a polypeptide such as an albumin, e.g. HSA. The positions described in (c) (above) may be in a third Domain (e.g. Domain IIII) of a polypeptide such as an albumin, e.g. HSA.

The albumin variant or fragment thereof may further comprise an alteration (such as a substitution or insertion) at one more (several) positions corresponding to the following positions of SEQ ID No: 2:

(i) any of 417, 464, 492, 493, 494, 495, 496, 499, 500, 501, 503, 504, 505, 506, 510, 535, 536, 537, 538, 540, 550, 573, 574, 575, 577, 578, 579, 580, 581, 582, 584, (ii) any of 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or (iii) any of 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E).

It is preferred that the parent albumin and/or the variant albumin comprises or consists of:

(a) a polypeptide having at least 60% sequence identity to the mature polypeptide of SEQ ID NO: 2;

(b) a polypeptide encoded by a polynucleotide that hybridizes under low stringency conditions with (i) the mature polypeptide coding sequence of SEQ ID NO: 1, or (ii) the full-length complement of (i);

c) a polypeptide encoded by a polynucleotide having at least 60% identity to the mature polypeptide coding sequence of SEQ ID NO: 1; and/or (d) a fragment of the mature polypeptide of SEQ ID NO: 2.

Further preferences for the first aspect of the invention are provided below the thirteenth aspect of the invention. The skilled person understands that any aspect of the invention may be combined with another aspect or aspects of the invention and/or with one or more (several) of the preferences for the aspects of the invention and/or other disclosures made herein.

A second aspect of the invention relates to a method for obtaining a variant albumin or fragments thereof, or fusion polypeptides comprising the variant albumin or fragments thereof, or associates of variant albumin or fragment thereof comprising:

(a) introducing into a parent albumin or fragments thereof, or fusion polypeptides comprising the parent albumin or fragments thereof an alteration at one or more (several) positions corresponding to positions 30 to 41, 75 to 91, 104 to 120, 144 to 150, 186 to 201, 414 to 426, 457 to 472, 492 to 538, 550 to 585, 276, 410, and/or 411 of the mature polypeptide of SEQ ID NO: 2, wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, and/or (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585; and (b) recovering the variant albumin or fragments thereof, or fusion polypeptides comprising the variant albumin or fragments thereof. T Therefore, positions may be selected from one or more (several) of: 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 417, 418, 419, 420, 421, 422, 423, 424, 425, 426, 457, 458, 459, 460, 461, 462, 463, 464, 465, 466, 467, 468, 469, 470, 471, 472, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 550, 551, 552, 553, 554, 555, 556, 557, 558, 559, 560, 561, 562, 563, 564, 565, 567, 568, 569, 570, 571, 572, 573, 574, 575, 576, 577, 578, 579, 580, 581, 582, 583, 584, 585.

Furthermore introduction of a stop codon may be made at any of positions 497 to 585, i.e. any of positions 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585 (or equivalent position, relative to SEQ ID NO: 2). The introduction may be made by insertion or substitution. Introduction of such a stop codon may be in addition to or instead of an alteration described herein.

Therefore, the second aspect of the invention relates to a method for obtaining a variant albumin or fragments thereof, or fusion polypeptides comprising the variant albumin or fragments thereof, or associates of variant albumin or fragment thereof comprising:

(a) introducing into a parent albumin or fragments thereof, or fusion polypeptides comprising the parent albumin or fragments thereof an alteration at one or more (several) positions corresponding to positions albumin variant or fragment thereof having altered binding affinity to FcRn compared with a parent or reference albumin, comprising an alteration (such as a substitution, deletion or insertion) at:

(a) one or more (several) positions corresponding to the following positions of SEQ ID No: 2: any of 30, 31, 32, 33, 35, 36, 37, 39, 41, 77, 78, 79, 81, 84, 85, 87, 88, 89, 105, 106, 107, 108, 109, 110, 111, 112, 117, 118, 120, 144, 145, 146, 147, 148, 149, 150, 186, 187, 188, 189, 190, 191, 192, 193, 194, 195, 196, 197; and/or (b) one or more (several) positions corresponding to the following positions of SEQ ID No: 2: any of 189, 190, 191, 192, 193, 194, 195, 196, 197, 198, 199; and/or (c) one or more (several) positions corresponding to the following positions of SEQ ID No: 2: 414, 415, 416, 418, 419, 420, 421, 422, 423, 424, 425, 426, 457, 458, 459, 460, 462, 463, 465, 466, 467, 468, 469, 470, 472, 497, 498, 502, 507, 508, 509, 511, 515, 516, 517, 518, 519, 520, 521, 522, 523, 524, 525, 526, 527, 528, 529, 530, 531, 532, 534, 551, 552, 553, 554, 555, 556, 557, 561, 566, 568, 569, 570, 571, 572, 576, 583 wherein the altered binding affinity of the variant or fragment thereof is relative to the binding affinity of a reference such as a parent albumin or fragment which does not comprise the alteration.

The positions described in (a) (above) may be in a first Domain (e.g. Domain I) of a polypeptide such as an albumin, e.g. HSA. The positions described in (b) (above) may be in a second Domain (e.g. Domain II) of a polypeptide such as an albumin, e.g. HSA. The positions described in (c) (above) may be in a third Domain (e.g. Domain IIII) of a polypeptide such as an albumin, e.g. HSA.

The albumin variant or fragment thereof may further comprise an alteration (such as a substitution or insertion) at one more (several) positions corresponding to the following positions of SEQ ID No: 2:

(i) any of 417, 464, 492, 493, 494, 495, 496, 499, 500, 501, 503, 504, 505, 506, 510, 535, 536, 537, 538, 540, 550, 573, 574, 575, 577, 578, 579, 580, 581, 582, 584, (ii) any of 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or (iii) any of 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E).

It is preferred that the parent albumin and/or the variant albumin comprises or consists of:

(a) a polypeptide having at least 60% sequence identity to the mature polypeptide of SEQ ID NO: 2;

(b) a polypeptide encoded by a polynucleotide that hybridizes under low stringency conditions with (i) the mature polypeptide coding sequence of SEQ ID NO: 1, or (ii) the full-length complement of (i);

c) a polypeptide encoded by a polynucleotide having at least 60% identity to the mature polypeptide coding sequence of SEQ ID NO: 1; and/or (d) a fragment of the mature polypeptide of SEQ ID NO: 2.

The variants can be prepared by those skilled persons using any mutagenesis procedure known in the art, such as site-directed mutagenesis, synthetic gene construction, semi-synthetic gene construction, random mutagenesis, shuffling, etc.

Site-directed mutagenesis is a technique in which one or more (several) mutations (alterations) are created at one or more (several) defined sites in a polynucleotide encoding the parent.

Site-directed mutagenesis can be accomplished in vitro by PCR involving the use of oligonucleotide primers containing the desired mutation. Site-directed mutagenesis can also be performed in vitro by cassette mutagenesis involving the cleavage by a restriction enzyme at a site in the plasmid comprising a polynucleotide encoding the parent and subsequent ligation of an oligonucleotide containing the mutation in the polynucleotide. Usually the restriction enzyme that digests at the plasmid and the oligonucleotide is the same, permitting ligation of the plasmid and insert to one another. See, e.g., Scherer and Davis, 1979, *Proc. Natl. Acad. Sci. USA* 76: 4949-4955; and Barton et al., 1990, *Nucleic Acids Res.* 18: 7349-4966.

Site-directed mutagenesis can also be accomplished in vivo by methods known in the art. See, e.g., U.S. Patent Application Publication NO: 2004/0171154; Storici et al., 2001, *Nature Biotechnol.* 19: 773-776; Kren et al., 1998, *Nat. Med.* 4: 285-290; and Calissano and Macino, 1996, *Fungal Genet. Newslett.* 43: 15-16.

Any site-directed mutagenesis procedure can be used in the invention. There are many commercial kits available that can be used to prepare variants.

Synthetic gene construction entails in vitro synthesis of a designed polynucleotide molecule to encode a polypeptide of interest. Gene synthesis can be performed utilizing a number of techniques, such as the multiplex microchip-based technology described by Tian et al. (2004, *Nature* 432: 1050-1054) and similar technologies wherein oligonucleotides are synthesized and assembled upon photo-programmable microfluidic chips.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204) and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

Semi-synthetic gene construction is accomplished by combining aspects of synthetic gene construction, and/or site-directed mutagenesis, and/or random mutagenesis, and/or shuffling. Semi-synthetic construction is typified by a process utilizing polynucleotide fragments that are synthesized, in combination with PCR techniques. Defined regions of genes may thus be synthesized de novo, while other regions may be amplified using site-specific mutagenic primers, while yet other regions may be subjected to error-prone PCR or non-error prone PCR amplification. Polynucleotide sub sequences may then be shuffled.

Further preferences for the second aspect of the invention are provided below the thirteenth aspect of the invention.

Variants

A third aspect of the invention provides variant albumins or fragments thereof, or fusion polypeptides comprising the variant albumin or fragments thereof, of a parent albumin, comprising an alteration at one or more (several) positions corresponding to positions 30 to 41, 75 to 91, 104 to 120, 144 to 150, 186 to 201, 414 to 426, 457 to 472, 492 to 538, 550 to 585, 276, 410 and/or 411 of the mature polypeptide of SEQ ID NO: 2, wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, and/or (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585.

Furthermore a stop codon may be introduced at any of positions 497 to 585. The introduction may be made by insertion or substitution. Introduction of such a stop codon may be in addition to or instead of a mutation described herein.

Therefore, the third aspect of the invention provides variant albumins or fragments thereof, or fusion polypeptides comprising the variant albumin or fragments thereof, of a parent albumin, comprising an alteration (such as a substitution, deletion or insertion) at:

(a) one or more (several) positions corresponding to the following positions of SEQ ID No: 2: any of 30, 31, 32, 33, 35, 36, 37, 39, 41, 77, 78, 79, 81, 84, 85, 87, 88, 89, 105, 106, 107, 108, 109, 110, 111, 112, 117, 118, 120, 144, 145, 146, 147, 148, 149, 150, 186, 187, 188, 189, 190, 191, 192, 193, 194, 195, 196, 197; and/or (b) one or more (several) positions corresponding to the following positions of SEQ ID No: 2: any of 189, 190, 191, 192, 193, 194, 195, 196, 197, 198, 199; and/or (c) one or more (several) positions corresponding to the following positions of SEQ ID No: 2: 414, 415, 416, 418, 419, 420, 421, 422, 423, 424, 425, 426, 457, 458, 459, 460, 462, 463, 465, 466, 467, 468, 469, 470, 472, 497, 498, 502, 507, 508, 509, 511, 515, 516, 517, 518, 519, 520, 521, 522, 523, 524, 525, 526, 527, 528, 529, 530, 531, 532, 534, 551, 552, 553, 554, 555, 556, 557, 561, 566, 568, 569, 570, 571, 572, 576, 583.

The positions described in (a) (above) may be in a first Domain (e.g. Domain I) of a polypeptide such as an albumin, e.g. HSA. The positions described in (b) (above) may be in a second Domain (e.g. Domain II) of a polypeptide such as an albumin, e.g. HSA. The positions described in (c) (above) may be in a third Domain (e.g. Domain IIII) of a polypeptide such as an albumin, e.g. HSA.

The albumin variant or fragment thereof may further comprise an alteration (such as a substitution or insertion) at one more (several) positions corresponding to the following positions of SEQ ID No: 2:

(i) any of 417, 464, 492, 493, 494, 495, 496, 499, 500, 501, 503, 504, 505, 506, 510, 535, 536, 537, 538, 540, 550, 573, 574, 575, 577, 578, 579, 580, 581, 582, 584, (ii) any of 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or (iii) any of 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E).

It is preferred that the parent albumin and/or the variant albumin comprises or consists of:

(a) a polypeptide having at least 60% sequence identity to the mature polypeptide of SEQ ID NO: 2;

(b) a polypeptide encoded by a polynucleotide that hybridizes under low stringency conditions with (i) the mature polypeptide coding sequence of SEQ ID NO: 1, or (ii) the full-length complement of (i);

c) a polypeptide encoded by a polynucleotide having at least 60% identity to the mature polypeptide coding sequence of SEQ ID NO: 1; and/or (d) a fragment of the mature polypeptide of SEQ ID NO: 2.

The variant albumin, a fragment thereof, or albumin part of a fusion polypeptide comprising variant albumin or a fragment thereof according to the invention has generally a sequence identity the sequence of HSA shown in SEQ ID NO: 2 of at least 60%, preferably at least 70%, preferably at least 80%, preferably at least 85%, preferably at least 90%, more preferred at least 95%, more preferred at least 96%, more preferred at least 97%, more preferred at least 98% and most preferred at least 99%.

In one aspect, the number of alterations in the variants of the invention is 1-20, e.g., 1-10 and 1-5, such as 1, 2, 3, 4, 5, 6, 7, 8, 9 or 10 alterations.

The variant albumin, a fragment thereof or fusion polypeptide comprising the variant albumin or fragment thereof has altered binding affinity to FcRn and/or an altered plasma half-life compared with the corresponding parent or reference albumin, fragment thereof, or fusion polypeptide comprising the variant albumin or fragment thereof and/or an altered binding affinity to FcRn.

In a particular preferred embodiment the parent or reference albumin is HSA and the variant albumin, a fragment thereof or fusion polypeptide comprising the variant albumin or fragment thereof has altered binding affinity to FcRn and/or an altered plasma half-life compared with the HSA, the corresponding fragment or fusion polypeptide comprising HSA or fragment thereof and/or an altered binding affinity to FcRn.

The correlation between binding of albumin to its receptor and plasma half-life has been realized by the present inventors based on the natural occurring allele of HSA D494N. The inventors have previously analyzed this allele and found that it has a lower affinity to its receptor FcRn than the affinity of WT HSA to FcRn.

Further, it has been disclosed that a transgenic mouse having the natural mouse FcRn replaced with human FcRn has a higher serum albumin level than normal mouse (J Exp Med. (2003) 197 (3):315-22). The inventors have previously discovered that human FcRn has a higher affinity to mouse serum albumin than mouse FcRn has to mouse serum albumin and, therefore, the observed increase in serum albumin in the transgenic mice corresponds with a higher affinity between serum albumin and its receptor, confirming the correlation between albumin binding to FcRn and plasma half-life. In addition, variants of albumin that have little or no binding to FcRn have been shown to have reduced half-life in a mouse model, Kenanova et al (2009) *J. Nucl. Med.;* 50 (Supplement 2):1582).

One way to determine whether the affinity of a variant albumin to FcRn is higher or lower than the parent or reference albumin is to use the Surface Plasmon Resonance assay (SPR) as described below. The skilled person will understand that other methods might be useful to determine whether the affinity of a variant albumin to FcRn is higher or lower than the affinity of the parent or reference albumin to FcRn, e.g., determination and comparison of the binding constants KD. Thus, according to the invention variant albumins having a KD that is lower than the KD for natural HSA is considered to have a higher plasma half-life than HSA and variant albumins having a KD that is higher than the KD for natural HSA is considered to have a lower plasma half-life than HSA.

The variants of albumin or fragments thereof or fusion polypeptides comprising albumin or fragments thereof comprise one or more (several) alterations, such as substitutions, deletions or insertions at one or more (several) positions corresponding to the positions in HSA selected from the group consisting of 30 to 41, 75 to 91, 104 to 120, 144 to 150, 186 to 201, 414 to 426, 457 to 472, 492 to 538, 550 to 585, 276, 410 and/or 411 of the mature polypeptide of SEQ ID NO: 2 and/or introduction of a stop codon may be made at any of positions 497 to 585 of the mature polypeptide of SEQ ID NO: 2, wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585. The introduction may be made by insertion or substitution. Introduction of such a stop codon may be in addition to or instead of an alteration described herein. The substitution may be any substitution where the amino acid in the natural albumin sequence is substituted with a different amino acid selected among the remaining 19 natural occurring amino acids.

In one aspect, a variant comprises an alteration at one or more (several) positions corresponding to positions 30 to 41, 75 to 91, 104 to 120, 144 to 150, 186 to 201, 414 to 426, 457 to 472, 492 to 538, 550 to 585, 276, 410 and/or 411 of the mature polypeptide of SEQ ID NO: 2, wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585.

In another aspect, a variant comprises an alteration at two or more (several) positions corresponding to any of 30 to 41, 75 to 91, 104 to 120, 144 to 150, 186 to 201, 414 to 426, 457 to 472, 492 to 538, 550 to 585, and/or 276, 410, 411 of the mature polypeptide of SEQ ID NO: 2, wherein, it is preferred that, when the variant, fragment or fusion thereof comprises one or more (several) substitutions at positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584 the variant, fragment or fusion thereof also comprises one or more (several) substitutions at a position selected from group consisting of 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585. It is also preferred that when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585.

In another aspect, a variant comprises an alteration at three positions corresponding to any of positions 30 to 41, 75 to 91, 104 to 120, 144 to 150, 186 to 201, 414 to 426, 457 to 472, 492 to 538, 550 to 585, 276, 410, and/or 411 of the mature polypeptide of SEQ ID NO: 2, wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585 and/or a stop codon inserted or substituted at a position selected from 497 to 585.

Possible insertions and substitutions for each of the mentioned positions are provided in Table 2 below.

TABLE 2

Possible and preferred alterations of a parent albumin, positions are relative to SEQ ID NO: 2, however the invention also includes equivalent positions in sequences other than SEQ ID No: 2.

| AA No. | AA | Substitution |
|---|---|---|
| 30 | Y | A, C, D, E, F, G, H, I, K, L, M, N, P, Q, R, S, T, V, W |
| 31 | L | A, C, D, E, F, G, H, I, K, M, N, P, Q, R, S, T, V, W, Y |
| 32 | Q | A, C, D, E, F, G, H, I, K, L, M, N, P, R, S, T, V, W, Y |
| 33 | Q | A, C, D, E, F, G, H, I, K, L, M, N, P, R, S, T, V, W, Y |
| 34 | C | A, D, E, F, G, H, I, K, L, M, N, P, Q, R, S, T, V, W, Y |
| 35 | P | A, C, D, E, F, G, H, I, K, L, M, N, Q, R, S, T, V, W, Y |
| 36 | F | A, C, D, E, G, H, I, K, L, M, N, P, Q, R, S, T, V, W, Y |
| 37 | E | A, C, D, F, G, H, I, K, L, M, N, P, Q, R, S, T, V, W, Y |
| 38 | D | A, C, E, F, G, H, I, K, L, M, N, P, Q, R, S, T, V, W, Y |
| 39 | H | A, C, D, E, F, G, I, K, L, M, N, P, Q, R, S, T, V, W, Y |
| 40 | V | A, C, D, E, F, G, H, I, K, L, M, N, P, Q, R, S, T, W, Y |
| 41 | K | A, C, D, E, F, G, H, I, L, M, N, P, Q, R, S, T, V, W, Y |
| 75 | C | A, D, E, F, G, H, I, K, L, M, N, P, Q, R, S, T, V, W, Y |
| 76 | T | A, C, D, E, F, G, H, I, K, L, M, N, P, Q, R, S, V, W, Y |
| 77 | V | A, C, D, E, F, G, H, I, K, L, M, N, P, Q, R, S, T, W, Y |
| 78 | A | C, D, E, F, G, H, I, K, L, M, N, P, Q, R, S, T, V, W, Y |
| 79 | T | A, C, D, E, F, G, H, I, K, L, M, N, P, Q, R, S, V, W, Y |
| 80 | L | A, C, D, E, F, G, H, I, K, M, N, P, Q, R, S, T, V, W, Y |
| 81 | R | A, C, D, E, F, G, H, I, K, L, M, N, P, Q, S, T, V, W, Y |
| 82 | E | A, C, D, F, G, H, I, K, L, M, N, P, Q, R, S, T, V, W, Y |
| 83 | T | A, C, D, E, F, G, H, I, K, L, M, N, P, Q, R, S, V, W, Y |
| 84 | Y | A, C, D, E, F, G, H, I, K, L, M, N, P, Q, R, S, T, V, W |
| 85 | G | A, C, D, E, F, H, I, K, L, M, N, P, Q, R, S, T, V, W, Y |
| 86 | E | A, C, D, F, G, H, I, K, L, M, N, P, Q, R, S, T, V, W, Y |
| 87 | M | A, C, D, E, F, G, H, I, K, L, N, P, Q, R, S, T, V, W, Y |
| 88 | A | C, D, E, F, G, H, I, K, L, M, N, P, Q, R, S, T, V, W, Y |
| 89 | D | A, C, E, F, G, H, I, K, L, M, N, P, Q, R, S, T, V, W, Y |
| 90 | C | A, D, E, F, G, H, I, K, L, M, N, P, Q, R, S, T, V, W, Y |

TABLE 2-continued

| Possible and preferred alterations of a parent albumin, positions are relative to SEQ ID NO: 2, however the invention also includes equivalent positions in sequences other than SEQ ID No: 2. | |
|---|---|
| 91 C | A, D, E, F, G, H, I, K, L, M, N, P, Q, R, S, T, V, W, Y |
| 104 Q | A, C, D, E, F, G, H, I, K, L, M, N, P, R, S, T, V, W, Y |
| 105 H | A, C, D, E, F, G, I, K, L, M, N, P, Q, R, S, T, V, W, Y |
| 106 K | A, C, D, E, F, G, H, I, L, M, N, P, Q, R, S, T, V, W, Y |
| 107 D | A, C, E, F, G, H, I, K, L, M, N, P, Q, R, S, T, V, W, Y |
| 108 D | A, C, E, F, G, H, I, K, L, M, N, P, Q, R, S, T, V, W, Y |
| 109 N | A, C, D, E, F, G, H, I, K, L, M, P, Q, R, S, T, V, W, Y |
| 110 P | A, C, D, E, F, G, H, I, K, L, M, N, Q, R, S, T, V, W, Y |
| 111 N | A, C, D, E, F, G, H, I, K, L, M, P, Q, R, S, T, V, W, Y |
| 112 L | A, C, D, E, F, G, H, I, K, M, N, P, Q, R, S, T, V, W, Y |
| 113 P | A, C, D, E, F, G, H, I, K, L, M, N, Q, R, S, T, V, W, Y |
| 114 R | A, C, D, E, F, G, H, I, K, L, M, N, P, Q, S, T, V, W, Y |
| 115 L | A, C, D, E, F, G, H, I, K, M, N, P, Q, R, S, T, V, W, Y |
| 116 V | A, C, D, E, F, G, H, I, K, L, M, N, P, Q, R, S, T, W, Y |
| 117 R | A, C, D, E, F, G, H, I, K, L, M, N, P, Q, S, T, V, W, Y |
| 118 P | A, C, D, E, F, G, H, I, K, L, M, N, Q, R, S, T, V, W, Y |
| 119 E | A, C, D, F, G, H, I, K, L, M, N, P, Q, R, S, T, V, W, Y |
| 120 V | A, C, D, E, F, G, H, I, K, L, M, N, P, Q, R, S, T, W, Y |
| 144 R | A, C, D, E, F, G, H, I, K, L, M, N, P, Q, S, T, V, W, Y |
| 145 R | A, C, D, E, F, G, H, I, K, L, M, N, P, Q, S, T, V, W, Y |
| 146 H | A, C, D, E, F, G, I, K, L, M, N, P, Q, R, S, T, V, W, Y |
| 147 P | A, C, D, E, F, G, H, I, K, L, M, N, Q, R, S, T, V, W, Y |
| 148 Y | A, C, D, E, F, G, H, I, K, L, M, N, P, Q, R, S, T, V, W |
| 149 F | A, C, D, E, G, H, I, K, L, M, N, P, Q, R, S, T, V, W, Y |
| 150 Y | A, C, D, E, F, G, H, I, K, L, M, N, P, Q, R, S, T, V, W |
| 186 R | A, C, D, E, F, G, H, I, K, L, M, N, P, Q, S, T, V, W, Y |
| 187 D | A, C, E, F, G, H, I, K, L, M, N, P, Q, R, S, T, V, W, Y |
| 188 E | A, C, D, F, G, H, I, K, L, M, N, P, Q, R, S, T, V, W, Y |
| 189 G | A, C, D, E, F, H, I, K, L, M, N, P, Q, R, S, T, V, W, Y |
| 190 K | A, C, D, E, F, G, H, I, L, M, N, P, Q, R, S, T, V, W, Y |
| 191 A | C, D, E, F, G, H, I, K, L, M, N, P, Q, R, S, T, V, W, Y |
| 192 S | A, C, D, E, F, G, H, I, K, L, M, N, P, Q, R, T, V, W, Y |
| 193 S | A, C, D, E, F, G, H, I, K, L, M, N, P, Q, R, T, V, W, Y |
| 194 A | C, D, E, F, G, H, I, K, L, M, N, P, Q, R, S, T, V, W, Y |
| 195 K | A, C, D, E, F, G, H, I, L, M, N, P, Q, R, S, T, V, W, Y |
| 196 Q | A, C, D, E, F, G, H, I, K, L, M, N, P, R, S, T, V, W, Y |
| 197 R | A, C, D, E, F, G, H, I, K, L, M, N, P, Q, S, T, V, W, Y |
| 198 L | A, C, D, E, F, G, H, I, K, M, N, P, Q, R, S, T, V, W, Y |

TABLE 2-continued

| Possible and preferred alterations of a parent albumin, positions are relative to SEQ ID NO: 2, however the invention also includes equivalent positions in sequences other than SEQ ID No: 2. | |
|---|---|
| 199 K | A, C, D, E, F, G, H, I, L, M, N, P, Q, R, S, T, V, W, Y |
| 200 C | A, D, E, F, G, H, I, K, L, M, N, P, Q, R, S, T, V, W, Y |
| 201 A | C, D, E, F, G, H, I, K, L, M, N, P, Q, R, S, T, V, W, Y |
| 276 K | A, C, D, E, F, G, H, I, L, M, N, P, Q, R, S, T, V, W, Y |
| 410 R | A, C, D, E, F, G, H, I, K, L, M, N, P, Q, S, T, V, W, Y |
| 411 Y | A, C, D, E, F, G, H, I, K, L, M, N, P, Q, R, S, T, V, W |
| 414 K | A, C, D, E, F, G, H, I, L, M, N, P, Q, R, S, T, V, W, Y |
| 415 V | A, C, D, E, F, G, H, I, K, L, M, N, P, Q, R, S, T, W, Y |
| 416 P | A, C, D, E, F, G, H, I, K, L, M, N, Q, R, S, T, V, W, Y |
| 417 Q | A, C, D, E, F, G, H, I, K, L, M, N, P, R, S, T, V, W, Y |
| 418 V | A, C, D, E, F, G, H, I, K, L, M, N, P, Q, R, S, T, W, Y |
| 419 S | A, C, D, E, F, G, H, I, K, L, M, N, P, Q, R, T, V, W, Y |
| 420 T | A, C, D, E, F, G, H, I, K, L, M, N, P, Q, R, S, V, W, Y |
| 421 P | A, C, D, E, F, G, H, I, K, L, M, N, Q, R, S, T, V, W, Y |
| 422 T | A, C, D, E, F, G, H, I, K, L, M, N, P, Q, R, S, V, W, Y |
| 423 L | A, C, D, E, F, G, H, I, K, M, N, P, Q, R, S, T, V, W, Y |
| 424 V | A, C, D, E, F, G, H, I, K, L, M, N, P, Q, R, S, T, W, Y |
| 425 E | A, C, D, F, G, H, I, K, L, M, N, P, Q, R, S, T, V, W, Y |
| 426 V | A, C, D, E, F, G, H, I, K, L, M, N, P, Q, R, S, T, W, Y |
| 457 L | A, C, D, E, F, G, H, I, K, M, N, P, Q, R, S, T, V, W, Y |
| 458 N | A, C, D, E, F, G, H, I, K, L, M, P, Q, R, S, T, V, W, Y |
| 459 Q | A, C, D, E, F, G, H, I, K, L, M, N, P, R, S, T, V, W, Y |
| 460 L | A, C, D, E, F, G, H, I, K, M, N, P, Q, R, S, T, V, W, Y |
| 461 C | A, D, E, F, G, H, I, K, L, M, N, P, Q, R, S, T, V, W, Y |
| 462 V | A, C, D, E, F, G, H, I, K, L, M, N, P, Q, R, S, T, W, Y |
| 463 L | A, C, D, E, F, G, H, I, K, M, N, P, Q, R, S, T, V, W, Y |
| 464 H | A, C, D, E, F, G, I, K, L, M, N, P, Q, R, S, T, V, W, Y |
| 465 E | A, C, D, F, G, H, I, K, L, M, N, P, Q, R, S, T, V, W, Y |
| 466 K | A, C, D, E, F, G, H, I, L, M, N, P, Q, R, S, T, V, W, Y |
| 467 T | A, C, D, E, F, G, H, I, K, L, M, N, P, Q, R, S, V, W, Y |
| 468 P | A, C, D, E, F, G, H, I, K, L, M, N, Q, R, S, T, V, W, Y |
| 469 V | A, C, D, E, F, G, H, I, K, L, M, N, P, Q, R, S, T, W, Y |
| 470 S | A, C, D, E, F, G, H, I, K, L, M, N, P, Q, R, T, V, W, Y |
| 471 D | A, C, E, F, G, H, I, K, L, M, N, P, Q, R, S, T, V, W, Y |
| 472 R | A, C, D, E, F, G, H, I, K, L, M, N, P, Q, S, T, V, W, Y |
| 492 E | A, C, D, F, G, H, I, K, L, M, N, P, Q, R, S, T, V, W, Y |
| 493 V | A, C, D, E, F, G, H, I, K, L, M, N, P, Q, R, S, T, W, Y |
| 494 D | A, C, E, F, G, H, I, K, L, M, N, P, Q, R, S, T, V, W, Y |

TABLE 2-continued

| Possible and preferred alterations of a parent albumin, positions are relative to SEQ ID NO: 2, however the invention also includes equivalent positions in sequences other than SEQ ID No: 2. | |
|---|---|
| 495 E | A, C, D, F, G, H, I, K, L, M, N, P, Q, R, S, T, V, W, Y |
| 496 T | A, C, D, E, F, G, H, I, K, L, M, N, P, Q, R, S, V, W, Y |
| 497 Y | A, C, D, E, F, G, H, I, K, L, M, N, P, Q, R, S, T, V, W |
| 498 V | A, C, D, E, F, G, H, I, K, L, M, N, P, Q, R, S, T, W, Y |
| 499 P | A, C, D, E, F, G, H, I, K, L, M, N, Q, R, S, T, V, W, Y |
| 500 K | A, C, D, E, F, G, H, I, L, M, N, P, Q, R, S, T, V, W, Y |
| 501 E | A, C, D, F, G, H, I, K, L, M, N, P, Q, R, S, T, V, W, Y |
| 502 F | A, C, D, E, G, H, I, K, L, M, N, P, Q, R, S, T, V, W, Y |
| 503 N | A, C, D, E, F, G, H, I, K, L, M, P, Q, R, S, T, V, W, Y |
| 504 A | C, D, E, F, G, H, I, K, L, M, N, P, Q, R, S, T, V, W, Y |
| 505 E | A, C, D, F, G, H, I, K, L, M, N, P, Q, R, S, T, V, W, Y |
| 506 T | A, C, D, E, F, G, H, I, K, L, M, N, P, Q, R, S, V, W, Y |
| 507 F | A, C, D, E, G, H, I, K, L, M, N, P, Q, R, S, T, V, W, Y |
| 508 T | A, C, D, E, F, G, H, I, K, L, M, N, P, Q, R, S, V, W, Y |
| 509 F | A, C, D, E, G, H, I, K, L, M, N, P, Q, R, S, T, V, W, Y |
| 510 H | A, C, D, E, F, G, I, K, L, M, N, P, Q, R, S, T, V, W, Y |
| 511 A | C, D, E, F, G, H, I, K, L, M, N, P, Q, R, S, T, V, W, Y |
| 512 D | A, C, E, F, G, H, I, K, L, M, N, P, Q, R, S, T, V, W, Y |
| 513 I | A, C, D, E, F, G, H, K, L, M, N, P, Q, R, S, T, V, W, Y |
| 514 C | A, D, E, F, G, H, I, K, L, M, N, P, Q, R, S, T, V, W, Y |
| 515 T | A, C, D, E, F, G, H, I, K, L, M, N, P, Q, R, S, V, W, Y |
| 516 L | A, C, D, E, F, G, H, I, K, M, N, P, Q, R, S, T, V, W, Y |
| 517 S | A, C, D, E, F, G, H, I, K, L, M, N, P, Q, R, T, V, W, Y |
| 518 E | A, C, D, F, G, H, I, K, L, M, N, P, Q, R, S, T, V, W, Y |
| 519 K | A, C, D, E, F, G, H, I, L, M, N, P, Q, R, S, T, V, W, Y |
| 520 E | A, C, D, F, G, H, I, K, L, M, N, P, Q, R, S, T, V, W, Y |
| 521 R | A, C, D, E, F, G, H, I, K, L, M, N, P, Q, S, T, V, W, Y |
| 522 Q | A, C, D, E, F, G, H, I, K, L, M, N, P, R, S, T, V, W, Y |
| 523 I | A, C, D, E, F, G, H, K, L, M, N, P, Q, R, S, T, V, W, Y |
| 524 K | A, C, D, E, F, G, H, I, L, M, N, P, Q, R, S, T, V, W, Y |
| 525 K | A, C, D, E, F, G, H, I, L, M, N, P, Q, R, S, T, V, W, Y |
| 526 Q | A, C, D, E, F, G, H, I, K, L, M, N, P, R, S, T, V, W, Y |
| 527 T | A, C, D, E, F, G, H, I, K, L, M, N, P, Q, R, S, V, W, Y |
| 528 A | C, D, E, F, G, H, I, K, L, M, N, P, Q, R, S, T, V, W, Y |
| 529 L | A, C, D, E, F, G, H, I, K, M, N, P, Q, R, S, T, V, W, Y |
| 530 V | A, C, D, E, F, G, H, I, K, L, M, N, P, Q, R, S, T, W, Y |
| 531 E | A, C, D, F, G, H, I, K, L, M, N, P, Q, R, S, T, V, W, Y |
| 532 L | A, C, D, E, F, G, H, I, K, M, N, P, Q, R, S, T, V, W, Y |

TABLE 2-continued

| Possible and preferred alterations of a parent albumin, positions are relative to SEQ ID NO: 2, however the invention also includes equivalent positions in sequences other than SEQ ID No: 2. | |
|---|---|
| 533 V | A, C, D, E, F, G, H, I, K, L, M, N, P, Q, R, S, T, W, Y |
| 534 K | A, C, D, E, F, G, H, I, L, M, N, P, Q, R, S, T, V, W, Y |
| 535 H | A, C, D, E, F, G, I, K, L, M, N, P, Q, R, S, T, V, W, Y |
| 536 K | A, C, D, E, F, G, H, I, L, M, N, P, Q, R, S, T, V, W, Y |
| 537 P | A, C, D, E, F, G, H, I, K, L, M, N, Q, R, S, T, V, W, Y |
| 538 K | A, C, D, E, F, G, H, I, L, M, N, P, Q, R, S, T, V, W, Y |
| 550 D | A, C, E, F, G, H, I, K, L, M, N, P, Q, R, S, T, V, W, Y |
| 551 F | A, C, D, E, G, H, I, K, L, M, N, P, Q, R, S, T, V, W, Y |
| 552 A | C, D, E, F, G, H, I, K, L, M, N, P, Q, R, S, T, V, W, Y |
| 553 A | C, D, E, F, G, H, I, K, L, M, N, P, Q, R, S, T, V, W, Y |
| 554 F | A, C, D, E, G, H, I, K, L, M, N, P, Q, R, S, T, V, W, Y |
| 555 V | A, C, D, E, F, G, H, I, K, L, M, N, P, Q, R, S, T, W, Y |
| 556 E | A, C, D, F, G, H, I, K, L, M, N, P, Q, R, S, T, V, W, Y |
| 557 K | A, C, D, E, F, G, H, I, L, M, N, P, Q, R, S, T, V, W, Y |
| 558 C | A, D, E, F, G, H, I, K, L, M, N, P, Q, R, S, T, V, W, Y |
| 559 C | A, D, E, F, G, H, I, K, L, M, N, P, Q, R, S, T, V, W, Y |
| 560 K | A, C, D, E, F, G, H, I, L, M, N, P, Q, R, S, T, V, W, Y |
| 561 A | C, D, E, F, G, H, I, K, L, M, N, P, Q, R, S, T, V, W, Y |
| 562 D | A, C, E, F, G, H, I, K, L, M, N, P, Q, R, S, T, V, W, Y |
| 563 D | A, C, E, F, G, H, I, K, L, M, N, P, Q, R, S, T, V, W, Y |
| 564 K | A, C, D, E, F, G, H, I, L, M, N, P, Q, R, S, T, V, W, Y |
| 565 E | A, C, D, F, G, H, I, K, L, M, N, P, Q, R, S, T, V, W, Y |
| 566 T | A, C, D, E, F, G, H, I, K, L, M, N, P, Q, R, S, V, W, Y |
| 567 C | A, D, E, F, G, H, I, K, L, M, N, P, Q, R, S, T, V, W, Y |
| 568 F | A, C, D, E, G, H, I, K, L, M, N, P, Q, R, S, T, V, W, Y |
| 569 A | C, D, E, F, G, H, I, K, L, M, N, P, Q, R, S, T, V, W, Y |
| 570 E | A, C, D, F, G, H, I, K, L, M, N, P, Q, R, S, T, V, W, Y |
| 571 E | A, C, D, F, G, H, I, K, L, M, N, P, Q, R, S, T, V, W, Y |
| 572 G | A, C, D, E, F, H, I, K, L, M, N, P, Q, R, S, T, V, W, Y |
| 573 K | A, C, D, E, F, G, H, I, L, M, N, P, Q, R, S, T, V, W, Y |
| 574 K | A, C, D, E, F, G, H, I, L, M, N, P, Q, R, S, T, V, W, Y |
| 575 L | A, C, D, E, F, G, H, I, K, M, N, P, Q, R, S, T, V, W, Y |
| 576 V | A, C, D, E, F, G, H, I, K, L, M, N, P, Q, R, S, T, W, Y |
| 577 A | C, D, E, F, G, H, I, K, L, M, N, P, Q, R, S, T, V, W, Y |
| 578 A | C, D, E, F, G, H, I, K, L, M, N, P, Q, R, S, T, V, W, Y |
| 579 S | A, C, D, E, F, G, H, I, K, L, M, N, P, Q, R, T, V, W, Y |
| 580 Q | A, C, D, E, F, G, H, I, K, L, M, N, P, R, S, T, V, W, Y |
| 581 A | C, D, E, F, G, H, I, K, L, M, N, P, Q, R, S, T, V, W, Y |

TABLE 2-continued

| Possible and preferred alterations of a parent albumin, positions are relative to SEQ ID NO: 2, however the invention also includes equivalent positions in sequences other than SEQ ID No: 2. | |
|---|---|
| 582 A | C, D, E, F, G, H, I, K, L, M, N, P, Q, R, S, T, V, W, Y |
| 583 L | A, C, D, E, F, G, H, I, K, M, N, P, Q, R, S, T, V, W, Y |
| 584 G | A, C, D, E, F, H, I, K, L, M, N, P, Q, R, S, T, V, W, Y |
| 585 L | A, C, D, E, F, G, H, I, K, M, N, P, Q, R, S, T, V, W, Y |
| AA No. AA | Insertion |
| 30 Y | A, C, D, E, F, G, H, I, K, L, M, N, P, Q, R, S, T, V, W, Y |
| 31 L | A, C, D, E, F, G, H, I, K, L, M, N, P, Q, R, S, T, V, W, Y |
| 32 Q | A, C, D, E, F, G, H, I, K, L, M, N, P, Q, R, S, T, V, W, Y |
| 33 Q | A, C, D, E, F, G, H, I, K, L, M, N, P, Q, R, S, T, V, W, Y |
| 34 C | A, C, D, E, F, G, H, I, K, L, M, N, P, Q, R, S, T, V, W, Y |
| 35 P | A, C, D, E, F, G, H, I, K, L, M, N, P, Q, R, S, T, V, W, Y |
| 36 F | A, C, D, E, F, G, H, I, K, L, M, N, P, Q, R, S, T, V, W, Y |
| 37 E | A, C, D, E, F, G, H, I, K, L, M, N, P, Q, R, S, T, V, W, Y |
| 38 D | A, C, D, E, F, G, H, I, K, L, M, N, P, Q, R, S, T, V, W, Y |
| 39 H | A, C, D, E, F, G, H, I, K, L, M, N, P, Q, R, S, T, V, W, Y |
| 40 V | A, C, D, E, F, G, H, I, K, L, M, N, P, Q, R, S, T, V, W, Y |
| 41 K | A, C, D, E, F, G, H, I, K, L, M, N, P, Q, R, S, T, V, W, Y |
| 75 C | A, C, D, E, F, G, H, I, K, L, M, N, P, Q, R, S, T, V, W, Y |
| 76 T | A, C, D, E, F, G, H, I, K, L, M, N, P, Q, R, S, T, V, W, Y |
| 77 V | A, C, D, E, F, G, H, I, K, L, M, N, P, Q, R, S, T, V, W, Y |
| 78 A | A, C, D, E, F, G, H, I, K, L, M, N, P, Q, R, S, T, V, W, Y |
| 79 T | A, C, D, E, F, G, H, I, K, L, M, N, P, Q, R, S, T, V, W, Y |
| 80 L | A, C, D, E, F, G, H, I, K, L, M, N, P, Q, R, S, T, V, W, Y |
| 81 R | A, C, D, E, F, G, H, I, K, L, M, N, P, Q, R, S, T, V, W, Y |
| 82 E | A, C, D, E, F, G, H, I, K, L, M, N, P, Q, R, S, T, V, W, Y |
| 83 T | A, C, D, E, F, G, H, I, K, L, M, N, P, Q, R, S, T, V, W, Y |
| 84 Y | A, C, D, E, F, G, H, I, K, L, M, N, P, Q, R, S, T, V, W, Y |
| 85 G | A, C, D, E, F, G, H, I, K, L, M, N, P, Q, R, S, T, V, W, Y |
| 86 E | A, C, D, E, F, G, H, I, K, L, M, N, P, Q, R, S, T, V, W, Y |
| 87 M | A, C, D, E, F, G, H, I, K, L, M, N, P, Q, R, S, T, V, W, Y |
| 88 A | A, C, D, E, F, G, H, I, K, L, M, N, P, Q, R, S, T, V, W, Y |
| 89 D | A, C, D, E, F, G, H, I, K, L, M, N, P, Q, R, S, T, V, W, Y |
| 90 C | A, C, D, E, F, G, H, I, K, L, M, N, P, Q, R, S, T, V, W, Y |
| 91 C | A, C, D, E, F, G, H, I, K, L, M, N, P, Q, R, S, T, V, W, Y |
| 104 Q | A, C, D, E, F, G, H, I, K, L, M, N, P, Q, R, S, T, V, W, Y |
| 105 H | A, C, D, E, F, G, H, I, K, L, M, N, P, Q, R, S, T, V, W, Y |
| 106 K | A, C, D, E, F, G, H, I, K, L, M, N, P, Q, R, S, T, V, W, Y |
| 107 D | A, C, D, E, F, G, H, I, K, L, M, N, P, Q, R, S, T, V, W, Y |

TABLE 2-continued

| Possible and preferred alterations of a parent albumin, positions are relative to SEQ ID NO: 2, however the invention also includes equivalent positions in sequences other than SEQ ID No: 2. | |
|---|---|
| 108 D | A, C, D, E, F, G, H, I, K, L, M, N, P, Q, R, S, T, V, W, Y |
| 109 N | A, C, D, E, F, G, H, I, K, L, M, N, P, Q, R, S, T, V, W, Y |
| 110 P | A, C, D, E, F, G, H, I, K, L, M, N, P, Q, R, S, T, V, W, Y |
| 111 N | A, C, D, E, F, G, H, I, K, L, M, N, P, Q, R, S, T, V, W, Y |
| 112 L | A, C, D, E, F, G, H, I, K, L, M, N, P, Q, R, S, T, V, W, Y |
| 113 P | A, C, D, E, F, G, H, I, K, L, M, N, P, Q, R, S, T, V, W, Y |
| 114 R | A, C, D, E, F, G, H, I, K, L, M, N, P, Q, R, S, T, V, W, Y |
| 115 L | A, C, D, E, F, G, H, I, K, L, M, N, P, Q, R, S, T, V, W, Y |
| 116 V | A, C, D, E, F, G, H, I, K, L, M, N, P, Q, R, S, T, V, W, Y |
| 117 R | A, C, D, E, F, G, H, I, K, L, M, N, P, Q, R, S, T, V, W, Y |
| 118 P | A, C, D, E, F, G, H, I, K, L, M, N, P, Q, R, S, T, V, W, Y |
| 119 E | A, C, D, E, F, G, H, I, K, L, M, N, P, Q, R, S, T, V, W, Y |
| 120 V | A, C, D, E, F, G, H, I, K, L, M, N, P, Q, R, S, T, V, W, Y |
| 144 R | A, C, D, E, F, G, H, I, K, L, M, N, P, Q, R, S, T, V, W, Y |
| 145 R | A, C, D, E, F, G, H, I, K, L, M, N, P, Q, R, S, T, V, W, Y |
| 146 H | A, C, D, E, F, G, H, I, K, L, M, N, P, Q, R, S, T, V, W, Y |
| 147 P | A, C, D, E, F, G, H, I, K, L, M, N, P, Q, R, S, T, V, W, Y |
| 148 Y | A, C, D, E, F, G, H, I, K, L, M, N, P, Q, R, S, T, V, W, Y |
| 149 F | A, C, D, E, F, G, H, I, K, L, M, N, P, Q, R, S, T, V, W, Y |
| 150 Y | A, C, D, E, F, G, H, I, K, L, M, N, P, Q, R, S, T, V, W, Y |
| 186 R | A, C, D, E, F, G, H, I, K, L, M, N, P, Q, R, S, T, V, W, Y |
| 187 D | A, C, D, E, F, G, H, I, K, L, M, N, P, Q, R, S, T, V, W, Y |
| 188 E | A, C, D, E, F, G, H, I, K, L, M, N, P, Q, R, S, T, V, W, Y |
| 189 G | A, C, D, E, F, G, H, I, K, L, M, N, P, Q, R, S, T, V, W, Y |
| 190 K | A, C, D, E, F, G, H, I, K, L, M, N, P, Q, R, S, T, V, W, Y |
| 191 A | A, C, D, E, F, G, H, I, K, L, M, N, P, Q, R, S, T, V, W, Y |
| 192 S | A, C, D, E, F, G, H, I, K, L, M, N, P, Q, R, S, T, V, W, Y |
| 193 S | A, C, D, E, F, G, H, I, K, L, M, N, P, Q, R, S, T, V, W, Y |
| 194 A | A, C, D, E, F, G, H, I, K, L, M, N, P, Q, R, S, T, V, W, Y |
| 195 K | A, C, D, E, F, G, H, I, K, L, M, N, P, Q, R, S, T, V, W, Y |
| 196 Q | A, C, D, E, F, G, H, I, K, L, M, N, P, Q, R, S, T, V, W, Y |
| 197 R | A, C, D, E, F, G, H, I, K, L, M, N, P, Q, R, S, T, V, W, Y |
| 198 L | A, C, D, E, F, G, H, I, K, L, M, N, P, Q, R, S, T, V, W, Y |
| 199 K | A, C, D, E, F, G, H, I, K, L, M, N, P, Q, R, S, T, V, W, Y |
| 200 C | A, C, D, E, F, G, H, I, K, L, M, N, P, Q, R, S, T, V, W, Y |
| 201 A | A, C, D, E, F, G, H, I, K, L, M, N, P, Q, R, S, T, V, W, Y |
| 276 K | A, C, D, E, F, G, H, I, K, L, M, N, P, Q, R, S, T, V, W, Y |
| 410 R | A, C, D, E, F, G, H, I, K, L, M, N, P, Q, R, S, T, V, W, Y |

TABLE 2-continued

| Possible and preferred alterations of a parent albumin, positions are relative to SEQ ID NO: 2, however the invention also includes equivalent positions in sequences other than SEQ ID No: 2. | |
|---|---|
| 411 Y | A, C, D, E, F, G, H, I, K, L, M, N, P, Q, R, S, T, V, W, Y |
| 414 K | A, C, D, E, F, G, H, I, K, L, M, N, P, Q, R, S, T, V, W, Y |
| 415 V | A, C, D, E, F, G, H, I, K, L, M, N, P, Q, R, S, T, V, W, Y |
| 416 P | A, C, D, E, F, G, H, I, K, L, M, N, P, Q, R, S, T, V, W, Y |
| 417 Q | A, C, D, E, F, G, H, I, K, L, M, N, P, Q, R, S, T, V, W, Y |
| 418 V | A, C, D, E, F, G, H, I, K, L, M, N, P, Q, R, S, T, V, W, Y |
| 419 S | A, C, D, E, F, G, H, I, K, L, M, N, P, Q, R, S, T, V, W, Y |
| 420 T | A, C, D, E, F, G, H, I, K, L, M, N, P, Q, R, S, T, V, W, Y |
| 421 P | A, C, D, E, F, G, H, I, K, L, M, N, P, Q, R, S, T, V, W, Y |
| 422 T | A, C, D, E, F, G, H, I, K, L, M, N, P, Q, R, S, T, V, W, Y |
| 423 L | A, C, D, E, F, G, H, I, K, L, M, N, P, Q, R, S, T, V, W, Y |
| 424 V | A, C, D, E, F, G, H, I, K, L, M, N, P, Q, R, S, T, V, W, Y |
| 425 E | A, C, D, E, F, G, H, I, K, L, M, N, P, Q, R, S, T, V, W, Y |
| 426 V | A, C, D, E, F, G, H, I, K, L, M, N, P, Q, R, S, T, V, W, Y |
| 457 L | A, C, D, E, F, G, H, I, K, L, M, N, P, Q, R, S, T, V, W, Y |
| 458 N | A, C, D, E, F, G, H, I, K, L, M, N, P, Q, R, S, T, V, W, Y |
| 459 Q | A, C, D, E, F, G, H, I, K, L, M, N, P, Q, R, S, T, V, W, Y |
| 460 L | A, C, D, E, F, G, H, I, K, L, M, N, P, Q, R, S, T, V, W, Y |
| 461 C | A, C, D, E, F, G, H, I, K, L, M, N, P, Q, R, S, T, V, W, Y |
| 462 V | A, C, D, E, F, G, H, I, K, L, M, N, P, Q, R, S, T, V, W, Y |
| 463 L | A, C, D, E, F, G, H, I, K, L, M, N, P, Q, R, S, T, V, W, Y |
| 464 H | A, C, D, E, F, G, H, I, K, L, M, N, P, Q, R, S, T, V, W, Y |
| 465 E | A, C, D, E, F, G, H, I, K, L, M, N, P, Q, R, S, T, V, W, Y |
| 466 K | A, C, D, E, F, G, H, I, K, L, M, N, P, Q, R, S, T, V, W, Y |
| 467 T | A, C, D, E, F, G, H, I, K, L, M, N, P, Q, R, S, T, V, W, Y |
| 468 P | A, C, D, E, F, G, H, I, K, L, M, N, P, Q, R, S, T, V, W, Y |
| 469 V | A, C, D, E, F, G, H, I, K, L, M, N, P, Q, R, S, T, V, W, Y |
| 470 S | A, C, D, E, F, G, H, I, K, L, M, N, P, Q, R, S, T, V, W, Y |
| 471 D | A, C, D, E, F, G, H, I, K, L, M, N, P, Q, R, S, T, V, W, Y |
| 472 R | A, C, D, E, F, G, H, I, K, L, M, N, P, Q, R, S, T, V, W, Y |
| 492 E | A, C, D, E, F, G, H, I, K, L, M, N, P, Q, R, S, T, V, W, Y |
| 493 V | A, C, D, E, F, G, H, I, K, L, M, N, P, Q, R, S, T, V, W, Y |
| 494 D | A, C, D, E, F, G, H, I, K, L, M, N, P, Q, R, S, T, V, W, Y |
| 495 E | A, C, D, E, F, G, H, I, K, L, M, N, P, Q, R, S, T, V, W, Y |
| 496 T | A, C, D, E, F, G, H, I, K, L, M, N, P, Q, R, S, T, V, W, Y |
| 497 Y | A, C, D, E, F, G, H, I, K, L, M, N, P, Q, R, S, T, V, W, Y |
| 498 V | A, C, D, E, F, G, H, I, K, L, M, N, P, Q, R, S, T, V, W, Y |
| 499 P | A, C, D, E, F, G, H, I, K, L, M, N, P, Q, R, S, T, V, W, Y |

TABLE 2-continued

Possible and preferred alterations of a parent albumin, positions are relative to SEQ ID NO: 2, however the invention also includes equivalent positions in sequences other than SEQ ID No: 2.

| | |
|---|---|
| 500 K | A, C, D, E, F, G, H, I, K, L, M, N, P, Q, R, S, T, V, W, Y |
| 501 E | A, C, D, E, F, G, H, I, K, L, M, N, P, Q, R, S, T, V, W, Y |
| 502 F | A, C, D, E, F, G, H, I, K, L, M, N, P, Q, R, S, T, V, W, Y |
| 503 N | A, C, D, E, F, G, H, I, K, L, M, N, P, Q, R, S, T, V, W, Y |
| 504 A | A, C, D, E, F, G, H, I, K, L, M, N, P, Q, R, S, T, V, W, Y |
| 505 E | A, C, D, E, F, G, H, I, K, L, M, N, P, Q, R, S, T, V, W, Y |
| 506 T | A, C, D, E, F, G, H, I, K, L, M, N, P, Q, R, S, T, V, W, Y |
| 507 F | A, C, D, E, F, G, H, I, K, L, M, N, P, Q, R, S, T, V, W, Y |
| 508 T | A, C, D, E, F, G, H, I, K, L, M, N, P, Q, R, S, T, V, W, Y |
| 509 F | A, C, D, E, F, G, H, I, K, L, M, N, P, Q, R, S, T, V, W, Y |
| 510 H | A, C, D, E, F, G, H, I, K, L, M, N, P, Q, R, S, T, V, W, Y |
| 511 A | A, C, D, E, F, G, H, I, K, L, M, N, P, Q, R, S, T, V, W, Y |
| 512 D | A, C, D, E, F, G, H, I, K, L, M, N, P, Q, R, S, T, V, W, Y |
| 513 I | A, C, D, E, F, G, H, I, K, L, M, N, P, Q, R, S, T, V, W, Y |
| 514 C | A, C, D, E, F, G, H, I, K, L, M, N, P, Q, R, S, T, V, W, Y |
| 515 T | A, C, D, E, F, G, H, I, K, L, M, N, P, Q, R, S, T, V, W, Y |
| 516 L | A, C, D, E, F, G, H, I, K, L, M, N, P, Q, R, S, T, V, W, Y |
| 517 S | A, C, D, E, F, G, H, I, K, L, M, N, P, Q, R, S, T, V, W, Y |
| 518 E | A, C, D, E, F, G, H, I, K, L, M, N, P, Q, R, S, T, V, W, Y |
| 519 K | A, C, D, E, F, G, H, I, K, L, M, N, P, Q, R, S, T, V, W, Y |
| 520 E | A, C, D, E, F, G, H, I, K, L, M, N, P, Q, R, S, T, V, W, Y |
| 521 R | A, C, D, E, F, G, H, I, K, L, M, N, P, Q, R, S, T, V, W, Y |
| 522 Q | A, C, D, E, F, G, H, I, K, L, M, N, P, Q, R, S, T, V, W, Y |
| 523 I | A, C, D, E, F, G, H, I, K, L, M, N, P, Q, R, S, T, V, W, Y |
| 524 K | A, C, D, E, F, G, H, I, K, L, M, N, P, Q, R, S, T, V, W, Y |
| 525 K | A, C, D, E, F, G, H, I, K, L, M, N, P, Q, R, S, T, V, W, Y |
| 526 Q | A, C, D, E, F, G, H, I, K, L, M, N, P, Q, R, S, T, V, W, Y |
| 527 T | A, C, D, E, F, G, H, I, K, L, M, N, P, Q, R, S, T, V, W, Y |
| 528 A | A, C, D, E, F, G, H, I, K, L, M, N, P, Q, R, S, T, V, W, Y |
| 529 L | A, C, D, E, F, G, H, I, K, L, M, N, P, Q, R, S, T, V, W, Y |
| 530 V | A, C, D, E, F, G, H, I, K, L, M, N, P, Q, R, S, T, V, W, Y |
| 531 E | A, C, D, E, F, G, H, I, K, L, M, N, P, Q, R, S, T, V, W, Y |
| 532 L | A, C, D, E, F, G, H, I, K, L, M, N, P, Q, R, S, T, V, W, Y |
| 533 V | A, C, D, E, F, G, H, I, K, L, M, N, P, Q, R, S, T, V, W, Y |
| 534 K | A, C, D, E, F, G, H, I, K, L, M, N, P, Q, R, S, T, V, W, Y |
| 535 H | A, C, D, E, F, G, H, I, K, L, M, N, P, Q, R, S, T, V, W, Y |
| 536 K | A, C, D, E, F, G, H, I, K, L, M, N, P, Q, R, S, T, V, W, Y |
| 537 P | A, C, D, E, F, G, H, I, K, L, M, N, P, Q, R, S, T, V, W, Y |

TABLE 2-continued

| Possible and preferred alterations of a parent albumin, positions are relative to SEQ ID NO: 2, however the invention also includes equivalent positions in sequences other than SEQ ID No: 2. | |
|---|---|
| 538 K | A, C, D, E, F, G, H, I, K, L, M, N, P, Q, R, S, T, V, W, Y |
| 550 D | A, C, D, E, F, G, H, I, K, L, M, N, P, Q, R, S, T, V, W, Y |
| 551 F | A, C, D, E, F, G, H, I, K, L, M, N, P, Q, R, S, T, V, W, Y |
| 552 A | A, C, D, E, F, G, H, I, K, L, M, N, P, Q, R, S, T, V, W, Y |
| 553 A | A, C, D, E, F, G, H, I, K, L, M, N, P, Q, R, S, T, V, W, Y |
| 554 F | A, C, D, E, F, G, H, I, K, L, M, N, P, Q, R, S, T, V, W, Y |
| 555 V | A, C, D, E, F, G, H, I, K, L, M, N, P, Q, R, S, T, V, W, Y |
| 556 E | A, C, D, E, F, G, H, I, K, L, M, N, P, Q, R, S, T, V, W, Y |
| 557 K | A, C, D, E, F, G, H, I, K, L, M, N, P, Q, R, S, T, V, W, Y |
| 558 C | A, C, D, E, F, G, H, I, K, L, M, N, P, Q, R, S, T, V, W, Y |
| 559 C | A, C, D, E, F, G, H, I, K, L, M, N, P, Q, R, S, T, V, W, Y |
| 560 K | A, C, D, E, F, G, H, I, K, L, M, N, P, Q, R, S, T, V, W, Y |
| 561 A | A, C, D, E, F, G, H, I, K, L, M, N, P, Q, R, S, T, V, W, Y |
| 562 D | A, C, D, E, F, G, H, I, K, L, M, N, P, Q, R, S, T, V, W, Y |
| 563 D | A, C, D, E, F, G, H, I, K, L, M, N, P, Q, R, S, T, V, W, Y |
| 564 K | A, C, D, E, F, G, H, I, K, L, M, N, P, Q, R, S, T, V, W, Y |
| 565 E | A, C, D, E, F, G, H, I, K, L, M, N, P, Q, R, S, T, V, W, Y |
| 566 T | A, C, D, E, F, G, H, I, K, L, M, N, P, Q, R, S, T, V, W, Y |
| 567 C | A, C, D, E, F, G, H, I, K, L, M, N, P, Q, R, S, T, V, W, Y |
| 568 F | A, C, D, E, F, G, H, I, K, L, M, N, P, Q, R, S, T, V, W, Y |
| 569 A | A, C, D, E, F, G, H, I, K, L, M, N, P, Q, R, S, T, V, W, Y |
| 570 E | A, C, D, E, F, G, H, I, K, L, M, N, P, Q, R, S, T, V, W, Y |
| 571 E | A, C, D, E, F, G, H, I, K, L, M, N, P, Q, R, S, T, V, W, Y |
| 572 G | A, C, D, E, F, G, H, I, K, L, M, N, P, Q, R, S, T, V, W, Y |
| 573 K | A, C, D, E, F, G, H, I, K, L, M, N, P, Q, R, S, T, V, W, Y |
| 574 K | A, C, D, E, F, G, H, I, K, L, M, N, P, Q, R, S, T, V, W, Y |
| 575 L | A, C, D, E, F, G, H, I, K, L, M, N, P, Q, R, S, T, V, W, Y |
| 576 V | A, C, D, E, F, G, H, I, K, L, M, N, P, Q, R, S, T, V, W, Y |
| 577 A | A, C, D, E, F, G, H, I, K, L, M, N, P, Q, R, S, T, V, W, Y |
| 578 A | A, C, D, E, F, G, H, I, K, L, M, N, P, Q, R, S, T, V, W, Y |
| 579 S | A, C, D, E, F, G, H, I, K, L, M, N, P, Q, R, S, T, V, W, Y |
| 580 Q | A, C, D, E, F, G, H, I, K, L, M, N, P, Q, R, S, T, V, W, Y |
| 581 A | A, C, D, E, F, G, H, I, K, L, M, N, P, Q, R, S, T, V, W, Y |
| 582 A | A, C, D, E, F, G, H, I, K, L, M, N, P, Q, R, S, T, V, W, Y |
| 583 L | A, C, D, E, F, G, H, I, K, L, M, N, P, Q, R, S, T, V, W, Y |
| 584 G | A, C, D, E, F, G, H, I, K, L, M, N, P, Q, R, S, T, V, W, Y |
| 585 L | A, C, D, E, F, G, H, I, K, L, M, N, P, Q, R, S, T, V, W, Y |

In Table 2, above, reference is made to HSA (SEQ ID NO: 2). However, the invention also includes variants of non-human albumins and/or fragments of human or non-human albumin having the herein mentioned alterations at positions equivalent to those stated for HSA. The skilled person can identify equivalent positions by sequence alignment with SEQ ID NO: 2.

The variant may further comprise alterations are at one or more (several) positions selected from the group consisting of 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (numbers relative to SEQ ID No. 2), more particularly a substitution to or insertion of Cys at one or more (several) of these positions. For example, substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys to introduce a Cys which may be available for conjugation via its thiol group and/or a deletion of or substitution of one or more (several) of positions 91, 200, 461, 514, 558, 559, 567 from Cys, to a non-Cys residue which may break an existing disulphide bond to generate a Cys which may be available for conjugation via its thiol group. One or more (several) of these positions may be altered alone or, more preferably, in combination with another position or positions disclosed herein.

The variant may further comprise alterations are at one or more (several) positions selected from the group consisting of 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (numbers relative to SEQ ID No. 2). One or more (several) of these positions may be altered alone or, more preferably, in combination with another position or positions disclosed herein. It is preferred that if an alteration selected from more particularly one or more (several) of the following substitutions: D63N, E82K, E84K, D87N, L90P, K106E, R114G, E119K, V146E, H464A, H464N, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E, it is combined with an alteration at another position or positions disclosed herein.

For the avoidance of doubt, variants of albumin comprising a C-terminal truncation of from 1 to 88 amino acids are included in all aspects of the invention and also form an aspect of the invention in their own right. Therefore, a variant may comprise or consist of an albumin having a sequence equivalent to positions 1 to 497 to 1 to 584 of SEQ ID NO: 2. Such a variant may be prepared by introducing a stop codon at any of positions 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585. Thus the albumin may be truncated by 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88 relative to the parent albumin, or fragment thereof, from which it is derived. It is preferred that the truncation is no longer than 88 amino acids, therefore it is preferred that the albumin is be truncated by at most 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88 amino acids relative to the parent albumin, or fragment thereof, from which it is derived. It is less preferred that the variant comprises a stop codon at position 406, 407, 408, 409, 410, 411 or 585. The variant may or may not comprise one or more (several) other alterations as described herein. Truncations may be referred to as 'fragments'.

Preferred truncations are at positions from 500 to 584, such as from 573 or 574 to 584. Such variants are thus truncated relative to a parent albumin, e.g. HSA (SEQ ID NO: 2), but apply equally to fragments of albumin such as DII+DIII, DIII, or DI+DIII. The skilled person can determine the location of the truncation within such a fragment by alignment of the fragment with HSA. Thus the variant may comprise or consist of the N-terminal at least 85 to 99.5% of a parent albumin or fragment thereof, such as the N-terminal at least 85, 86, 87, 88, 89, 90, 91, 92, 93, 94, 95, 96, 97, 98, 99 or 99.5%. Preferred truncations comprise the N-terminal 85, 86, 97 or 98% of a parent albumin or fragment thereof. Accordingly, methods of preparation, fragments, fusions, conjugates, nanoparticles, associates and compositions may comprise such a truncated variant. It is preferred that the truncated variant retains position 573 (or equivalent thereof). It is further preferred that the amino acid at 573 is Pro, Trp or Tyr.

In one embodiment the variant albumin or fragments thereof, or fusion polypeptides comprising the variant albumin or fragments thereof according to the invention contains one substitution at a position corresponding to a position in HSA selected from the group consisting of 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585, in SEQ ID NO: 2.

In one embodiment the variant albumin or fragments thereof, or fusion polypeptides comprising the variant albumin or fragments thereof according to the invention contains one substitution at a position corresponding to a position in HSA selected from the group consisting of 30, 31, 32, 33, 35, 36, 37, 39, 41, 77, 78, 79, 81, 84, 85, 87, 88, 89, 105, 106, 107, 108, 109, 110, 111, 112, 117, 118, 120, 144, 145, 146, 147, 148, 149, 150, 186, 187, 188, 189, 190, 191, 192, 193, 194, 195, 196, 197, 198, 199, 201, 276, 410, 411, 414, 415, 416, 418, 419, 420, 421, 422, 423, 424, 425, 426, 457, 458, 459, 460, 462, 463, 465, 466, 467, 468, 469, 470, 472, 497, 502, 507, 508, 509, 511, 513, 515, 516, 517, 518, 519, 520, 521, 522, 523, 524, 525, 526, 527, 528, 529, 530, 531, 532, 534, 551, 552, 553, 554, 555, 556, 557, 561, 568, 569, 570, 571, 572, 576, 583, in SEQ ID NO: 2.

The variant albumin, fragment thereof or fusion polypeptides comprising variant albumin or a fragment thereof according to the invention may comprise additional substitutions, insertions or deletions at one or more (several) positions corresponding to other positions in HSA.

In another embodiment the variant albumin or fragments thereof, or fusion polypeptides comprising variant albumin or fragments thereof according to the invention contains two, three, four, five, six, seven, eight, nine, ten, eleven, twelve, thirteen, fourteen, fifteen, sixteen, seventeen, eighteen, nineteen, twenty or even more substitutions at positions corresponding to positions in HSA selected from the group consisting of 30 to 41, 75 to 91, 104 to 120, 144 to 150, 186 to 201, 414 to 426, 457 to 472, 492 to 538, 550 to 585, 276, 410 and/or 411 of the mature polypeptide of SEQ ID NO: 2, wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585. The variant albumin or fragments thereof, or fusion polypeptides comprising variant albumin or fragments thereof according to the invention may comprise additional substitutions, insertions or deletions at positions corresponding to other positions in HSA.

In a further embodiment the variants of albumin or fragments thereof, or fusion polypeptides comprising variant albumin or a fragment thereof according to the invention have a plasma half-life that is longer than the plasma half-life of the parent or reference albumin fragment thereof or fusion polypeptide comprising the parent or reference albumin or a fragment thereof and/or an stronger binding affinity to FcRn.

In a further embodiment the variants of albumin or fragments thereof, or fusion polypeptides comprising variant albumin or fragments thereof according to the invention have a plasma half-life that is shorter than the plasma half-life of the parent or reference albumin fragment thereof or fusion polypeptide comprising the parent or reference albumin or a fragment thereof and/or an weaker binding affinity to FcRn.

In addition to the one or more (several) substitutions at one or more (several) positions corresponding to positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 in SEQ ID NO: 2 the variant albumin or fragments thereof, or fusion polypeptides comprising variant albumin or fragments thereof according to the invention may contain additional substitutions, deletions or insertions in other positions of the molecules. Such additional substitutions, deletions or insertions may be useful in order to alter other properties of the molecules such as but not limited to altered glycosylation; introduction of reactive groups of the surface such a thiol groups, removing/generating a carbamoylation site; etc.

Residues that might be altered in order to provide reactive residues on the surface and which advantageously could be applied to the invention has been disclosed in WO2010/092135 (incorporated herein by reference). Particular preferred residues include the positions corresponding to positions in SEQ ID NO: 2.

As examples of alterations that can be made in SEQ ID NO: 2 or in corresponding positions in other albumins in order to provide a reactive thiol group on the surface includes alterations corresponding to following alterations in SEQ ID NO: 2: L585C, D1C, A2C, D562C, A364C, A504C, E505C, T79C, E86C, D129C, D549C, A581C, D121C, E82C, S270C, A578C, L595LC, D1DC, A2AC, D562DC, A364AC, A504AC, E505EC, T79TC, E86EC, D129DC, D549DC, A581AC, A581AC, D121DC, E82EC, S270SC, A579AC, C360*, C316*, C75*, 0168*, C558*, C361*, C91*, C124*, C169* and C567*. Alternatively a cysteine residue may be added to the N or C terminal of albumin. The term 'reactive thiol' means and/or includes a thiol group provided by a Cys which is not disulphide bonded to a Cysteine and/or which is sterically available for binding to a partner such as a conjugation partner.

Polynucleotides

A fourth aspect of the invention relates to isolated polynucleotides that encode any of the variants of the invention. The polynucleotide may be an isolated polynucleotide. The polynucleotide may be comprised a in a vector (such as a plasmid) and/or in a host cell.

Nucleic Acid Constructs

The invention also relates to nucleic acid constructs comprising a polynucleotide encoding a variant of the invention operably linked to one or more (several) control sequences that direct the expression of the coding sequence in a suitable host cell under conditions compatible with the control sequences.

A polynucleotide may be manipulated in a variety of ways to provide for expression of a variant. Manipulation of the polynucleotide prior to its insertion into a vector may be desirable or necessary depending on the expression vector.

The techniques for modifying polynucleotides utilizing recombinant DNA methods are well known in the art.

The control sequence may be a promoter sequence, which is recognized by a host cell for expression of the polynucleotide. The promoter sequence contains transcriptional control sequences that mediate the expression of the variant. The promoter may be any nucleic acid sequence that shows transcriptional activity in the host cell including mutant, truncated, and hybrid promoters, and may be obtained from genes encoding extracellular or intracellular polypeptides either homologous or heterologous to the host cell.

In a yeast host, useful promoters are obtained from the genes for *Saccharomyces cerevisiae* enolase (ENO-1), *Saccharomyces cerevisiae* protease A (PRA1), *Saccharomyces cerevisiae* protease B (PRB1), *Saccharomyces cerevisiae* translation elongation factor (TEF1), *Saccharomyces cerevisiae* translation elongation factor (TEF2), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, *Yeast* 8: 423-488.

The skilled person knows useful promoters for use in rice and mammalian cells, such as CHO or HEK. In a rice host, useful promoters are obtained from cauliflower mosaic virus 35S RNA gene (CaMV35S), maize alcohol dehydrogenase (Adh1) and alpha Amy3.

In a mammalian host cell, such as CHO or HEK, useful promoters are obtained from Cytomegalovirus (CMV) and CAG hybrid promoter (hybrid of CMV early enhancer element and chicken beta-actin promoter), Simian vacuolating virus 40 (SV40).

The control sequence may also be a suitable transcription terminator sequence, which is recognized by a host cell to terminate transcription. The terminator sequence is operably linked to the 3'-terminus of the polynucleotide encoding the variant. Any terminator that is functional in the host cell may be used.

Preferred terminators for yeast host cells are obtained from the genes for *Saccharomyces cerevisiae* enolase, *Saccharomyces cerevisiae* cytochrome C (CYC1), *Saccharomyces cerevisiae* alcohol dehydrogenase (ADH1) and *Saccharomyces cerevisiae* glyceraldehyde-3-phosphate dehydrogenase. Other useful terminators for yeast host cells are described by Romanos et al., 1992, supra. Other useful terminators for yeast host cells are described by Romanos et al., 1992, supra. The skilled person knows useful terminators for use in rice and mammalian cells, such as CHO or HEK. For example, in a rice host, preferred terminators are obtained from *Agrobacterium tumefaciens* nopaline synthase (Nos) and cauliflower mosaic virus 35S RNA gene (CaMV35S)

The control sequence may also be a suitable leader sequence, a nontranslated region of an mRNA that is important for translation by the host cell. The leader sequence is operably linked to the 5'-terminus of the polynucleotide encoding the variant. Any leader sequence that is functional in the host cell may be used.

Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3'-terminus of the variant-encoding sequence and, when transcribed, is recognized by the host cell as a signal to add polyadenosine residues to transcribed mRNA. Any polyadenylation sequence that is functional in the host cell may be used.

Useful polyadenylation sequences for yeast host cells are described by Guo and Sherman, 1995, *Mol. Cellular Biol.* 15: 5983-5990.

The control sequence may also be a signal peptide coding region that encodes a signal peptide linked to the N-terminus of a variant and directs the variant into the cell's secretory pathway. The 5'-end of the coding sequence of the polynucleotide may inherently contain a signal peptide coding region naturally linked in translation reading frame with the segment of the coding region that encodes the variant. Alternatively, the 5'-end of the coding sequence may contain a signal peptide coding region that is foreign to the coding sequence. The foreign signal peptide coding region may be required where the coding sequence does not naturally contain a signal peptide coding region. Alternatively, the foreign signal peptide coding region may simply replace the natural signal peptide coding region in order to enhance secretion of the variant. However, any signal peptide coding region that directs the expressed variant into the secretory pathway of a host cell may be used.

Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra. The skilled person knows useful signal peptides for use in rice and mammalian cells, such as CHO or HEK.

Where both signal peptide and propeptide regions are present at the N-terminus of a variant, the propeptide region is positioned next to the N-terminus of the variant and the signal peptide region is positioned next to the N-terminus of the propeptide region.

Further preferences for the fourth aspect of the invention are provided below the thirteenth aspect of the invention.

Methods of Production

A fifth aspect of the invention relates to methods of preparation of a variant according to the invention. The variants of the invention can be prepared using techniques well known to the skilled person. One convenient way is by cloning nucleic acid encoding the parent albumin or a fragment thereof or fusion polypeptide comprising albumin or a fragment thereof, modifying said nucleic acid to introduce the desired substitution(s) at one or more (several) positions corresponding to positions 30 to 41, 75 to 91, 104 to 120, 144 to 150, 186 to 201, 414 to 426, 457 to 472, 492 to 538, 550 to 585, 276, 410 and/or 411 of the mature polypeptide of SEQ ID NO: 2, wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), or the group consisting of positions (iii) 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585, preparing a suitable genetic construct where the modified nucleic acid is placed in operative connection with suitable regulatory genetic elements, such as promoter, terminator, activation sites, ribosome binding sites etc., introducing the genetic construct into a suitable host organism, culturing the transformed host organism under conditions leading to expression of the variant and recovering the variant. All these techniques are known in the art and it is within the skills of the average practitioner to design a suitable method for preparing a particular variant according to the invention.

The variant polypeptide of the invention may also be connected to a signal sequence in order to have the variant polypeptide secreted into the growth medium during culturing of the transformed host organism. It is generally advantageous to have the variant polypeptide secreted into the growth medium in order to ease recovery and purification.

Techniques for preparing variant polypeptides have also been disclosed in WO 2009019314 (included by reference) and these techniques may also be applied to the invention.

Albumins have been successfully expressed as recombinant proteins in a range of hosts including fungi (including but not limited to *Aspergillus* (WO06066595), *Kluyveromyces* (Fleer 1991, *Bio/technology* 9, 968-975), *Pichia* (Kobayashi 1998 *Therapeutic Apheresis* 2, 257-262) and *Saccharomyces* (Sleep 1990, *Bio/technology* 8, 42-46)), bacteria (Pandjaitab 2000, *J. Allergy Clin. Immunol.* 105, 279-285)), animals (Barash 1993, *Transgenic Research* 2, 266-276) and plants (including but not limited to potato and tobacco (Sijmons 1990, *Bio/technology* 8, 217 and Farran 2002, *Transgenic Research* 11, 337-346) and rice e.g. *Oryza sativa*) and mammalian cells such as CHO and HEK. The variant polypeptide of the invention is preferably produced recombinantly in a suitable host cell. In principle any host cell capable of producing a polypeptide in suitable amounts may be used and it is within the skills of the average practitioner to select a suitable host cell according to the invention. A preferred host organism is yeast, preferably selected among Saccharomycacae, more preferred *Saccharomyces cerevisiae.*

The variant polypeptides of the invention may be recovered and purified from the growth medium using a combination of known separation techniques such as filtration, centrifugation, chromatography, and affinity separation techniques etc. It is within the skills of the average practitioner to purify the variants of the invention using a particular combination of such known separation steps. As an example of purification techniques that may be applied to the variants of the invention can be mentioned the teaching of WO00/44772.

The variant polypeptides of the invention may be used for delivering a therapeutically beneficial compound (including prophylactically beneficial compound such as a vaccine) to an animal or a human individual in need thereof. Such therapeutically beneficial compounds include, but are not limited, to labels and readily detectable compounds for use in diagnostics, such as various imaging techniques; pharmaceutical active compounds such as drugs, or specifically binding moieties such as antibodies. The variants of the invention may even be connected to two or more (several) different therapeutically beneficial compounds, e.g., an antibody and a drug, which gives the combined molecule the ability to bind specifically to a desired target and thereby provide a high concentration of the connected drug at that particular target.

Further preferences for the fifth aspect of the invention are provided below the thirteenth aspect of the invention.

Fusion Polypeptides

A sixth aspect of the invention relates to fusion polypeptides. Therefore, the variants of albumin or fragments thereof according to the invention may be fused with a non-albumin polypeptide fusion partner. The fusion partner may in principle be any polypeptide but generally it is preferred that the fusion partner is a polypeptide having therapeutic, prophylactic (including vaccine), diagnostic, imaging or other beneficial properties. Such properties may be referred to as 'pharmaceutically beneficial properties'. Fusion polypeptides comprising albumin or fragments thereof are known in the art. It has been found that such fusion polypeptides comprising albumin or a fragment thereof and a fusion partner polypeptide have a longer plasma half-life compared to the unfused fusion partner polypeptide alone. According to the invention it is possible to alter the plasma half-life of the fusion polypeptides according to the invention compared to the corresponding fusion polypeptides of the prior art. 'Alter' includes both increasing the plasma half-life or decreasing the plasma half-life. Increasing the plasma half-life is preferred. The invention allows tailoring of half-life to a term desired.

One or more (several) therapeutic, prophylactic (including vaccine), diagnostic, imaging or other beneficial may be fused to the N-terminus, the C-terminus of albumin, inserted into a loop in the albumin structure or any combination thereof. It may or it may not comprise linker sequences separating the various components of the fusion polypeptide.

Teachings relating to fusions of albumin or a fragment thereof are known in the art and the skilled person will appreciate that such teachings can also be applied to the invention. WO 2001/79271A (particularly page 9 and/or Table 1), WO 2003/59934A (particularly Table 1), WO03/060071 (particularly Table 1) and WO01/079480 (particularly Table 1) (each incorporated herein by reference in their entirety) also contain examples of therapeutic, prophylactic (including vaccine), diagnostic, imaging or other beneficial polypeptides that may be fused to albumin or fragments thereof, and these examples apply also to the invention. Further preferences for the sixth aspect of the invention are provided below the thirteenth aspect of the invention.

Conjugates

A seventh aspect of the invention relates to conjugates (conjugations). Therefore, the variants of albumin or fragments thereof according to the invention may be conjugated to a second molecule ('conjugation partner') using techniques known within the art. The conjugation partner may be a therapeutic, prophylactic (including vaccine), diagnostic, imaging or other beneficial moiety. Said conjugation partner may be a polypeptide or a non-polypeptide chemical. The conjugation partner may be a polypeptide, chemical (e.g. chemically synthesised drug) or a nucleic acid (e.g. DNA, RNA, siRNA).

Said second molecule may comprise a diagnostic or imaging moiety, and in this embodiment the conjugate may be useful as a diagnostic tool such as in imaging; or the second molecule may be a therapeutic or prophylactic (e.g. vaccine) compound and in this embodiment the conjugate may be used for therapeutic or prophylactic (e.g. vaccination) purposes where the conjugate will have the therapeutic or prophylactic properties of the therapeutic or prophylactic compound as well as the desirable plasma half-life provided by the albumin part of the conjugate. Conjugates of albumin and a therapeutic molecule are known in the art and it has been verified that such conjugates have long plasma half-life compared with the non-conjugated, free therapeutic molecule as such. According to the invention it is possible to alter the binding affinity to FcRn and/or plasma half-life of the conjugate according to the invention compared to the corresponding conjugates of the prior art. ‘Alter’ includes both increasing the plasma half-life and decreasing the plasma half-life binding affinity to FcRn and/or increasing the binding affinity and decreasing the binding affinity to FcRn. Increasing the plasma half-life and/or binding affinity to FcRn is preferred. The conjugates may conveniently be linked via a free thiol group present on the surface of HSA (amino acid residue 34 of mature HSA) using well known chemistry.

In one particular preferred aspect the variant albumin or fragment thereof is conjugated to a beneficial therapeutic or prophylactic (including vaccine) compound and the conjugate is used for treatment of a condition in a patient in need thereof, which condition is responsive to the particular selected therapeutic compound. Techniques for conjugating such a therapeutically useful compound to the variant albumin or fragment thereof are known in the art. WO 2009/019314 (incorporated herein by reference in its entirety) discloses examples of techniques suitable for conjugating a therapeutically compound to a polypeptide which techniques can also be applied to the invention. Further WO 2009/019314 discloses examples of compounds and moieties that may be conjugated to substituted transferrin and these examples may also be applied to the invention. The teaching of WO 2009/019314 is included herein by reference.

HSA contains in its natural form one free thiol group (at Cys34) that conveniently may be used for conjugation. As a particular embodiment within this aspect the variant albumin or fragment thereof may comprise further modifications provided to generate additional free thiol groups on the surface. This has the benefit that the payload of the variant albumin or fragment thereof is increased so that more than one molecule of the therapeutic (e.g. prophylactic) compound can be conjugated to each molecule of variant albumin or fragment thereof, or two or more (several) different therapeutic compounds may be conjugated to each molecule of variant albumin or fragment thereof, e.g., a compound having targeting properties such as an antibody specific for example a tumour; and a cytotoxic drug conjugated to the variant albumin or fragment thereof thereby creating a highly specific drug against a tumour. Teaching of particular residues that may be modified to provide for further free thiol groups on the surface can be found in co-pending patent application WO 2010/092135, which is incorporated by reference.

The conjugation partner may alternatively be conjugated to a fusion polypeptide (described herein), resulting in a molecule comprising a fusion partner fused to the albumin as well as a conjugation partner conjugated to the same albumin or even to the fusion partner.

Further preferences for the seventh aspect of the invention are provided below the thirteenth aspect of the invention.

Associates

An eighth aspect of the invention relates to associates. Therefore, the variants of albumin or fragments thereof may further be used in form of “associates”. In this connection the term “associate” is intended to mean a compound comprising a variant of albumin or a fragment thereof and another compound bound or associated to the variant albumin or fragment thereof by non-covalent binding. As an example of such an associate can be mentioned an associate consisting variant albumin and a lipid associated to albumin by a hydrophobic interaction. Such associates are known in the art and they may be prepared using well known techniques. As an example of a preferred associate according to the invention can be mentioned an associate comprising variant albumin and a taxane, a taxol or taxol derivative (e.g. paclitaxel). Further examples of associates comprise a therapeutic, prophylactic (including vaccine), diagnostic, imaging or other beneficial moiety.

The half-life of an albumin associate according to the invention may be longer or shorter than the half-life of the ‘other compound’ alone. The half-life of an albumin associate according to the invention may be longer or shorter than the half-life of the analogous/equivalent albumin associate comprising or consisting of a reference albumin such as native HSA (instead of an albumin variant or derivative according to the invention) and the ‘other compound’. Likewise, the binding affinity to FcRn an albumin associate according to the invention may be stronger or weaker than the binding affinity to FcRn of the analogous/equivalent albumin associate comprising or consisting of a reference albumin such as native HSA (instead of an albumin variant or derivative according to the invention) and the ‘other compound’. Methods for the preparation of associates are well-known to the skilled person, for example, formulation (by association) of HSA with Lipo-compounds is described in Hussain, R. and Siligardi, G. (2006) International Journal of Peptide Research and Therapeutics, Vol. 12, NO: 3, pp. 311-315. Further preferences for the eighth aspect of the invention are provided below the thirteenth aspect of the invention.

Other Uses

A ninth aspect of the invention relates to use of a variant albumin, fragment, fusion or conjugate thereof or nanoparticle or associate thereof. The variant albumin or fragments thereof or fusion polypeptides comprising variant albumin or fragments thereof according to the invention have the benefit that their binding affinity to FcRn and/or plasma half-life is altered compared to the parent or reference albumin or fragments thereof or fusion polypeptides comprising parent or reference albumin or fragments thereof. This has the advantage that the binding affinity to FcRn and/or plasma half-life of conjugates comprising variant albumin or a fragment thereof or fusion polypeptide comprising variant albumin or a fragment thereof, or an associate comprising variant albumin or a fragment thereof according to the invention can be selected in accordance with the particular therapeutic purpose.

For example for a conjugate, associate or fusion polypeptide used for imaging purposes in animals or human beings, where the imaging moiety has an very short half-life and a conjugate or a fusion polypeptide comprising HSA has a plasma half-life that is far longer than needed for the imaging purposes it would be advantageous to use a variant albumin or fragment thereof of the invention having a shorter plasma half-life than the parent or reference albumin or fragment thereof, to provide conjugates of fusion polypeptides having a plasma half-life that is sufficiently long for the imaging purpose but sufficiently short to be cleared form the body of the particular patient on which it is applied.

In another example for a conjugate, an associate or fusion polypeptide comprising a therapeutic compound effective to treat or alleviate a particular condition in a patient in need for such a treatment it would be advantageous to use the variant albumin or fragment thereof having a longer plasma half-life than the parent or reference albumin or fragment thereof, to provide associates or conjugates or fusion polypeptides having longer plasma half-lives which would have the benefit that the administration of the associate or conjugate or fusion polypeptide of the invention would be needed less frequently or reduced dose with less side effects compared to the situation where the parent or reference albumin or associates thereof or fragment thereof was used. For example, the invention provides a method of treating a proliferative disease in an individual, comprising administering the individual an effective amount of an associate according to the invention in which the associate comprises a taxane, a taxol or taxol derivative (e.g. paclitaxel).

In a further aspect the invention relates to compositions comprising the variant albumin, associates thereof or fragment thereof, variant albumin fragment or associates thereof or fusion polypeptide comprising variant albumin or fragment thereof according to the invention. The compositions are preferably pharmaceutical compositions. The composition may be prepared using techniques known in the area such as disclosed in recognized handbooks within the pharmaceutical field. Since the albumin, variant, fragment, fusion, conjugate or associate thereof has a binding affinity to FcRn and/or plasma half-life which is modulated (i.e. stronger or weaker and/or longer or shorter) than that of a reference molecule, the composition also has a binding affinity to FcRn and/or modulated plasma half-life relative to an equivalent composition comprising the reference molecule in place of the albumin, variant, fragment, fusion, conjugate or associate thereof as described herein. The composition may be a vaccine. The polypeptide according to the invention may be an active pharmaceutical or an excipient. Optionally, the composition is provided in unit dosage form.

Preferably the albumin, variant, fragment, fusion, conjugate or associate thereof has a plasma half-life that is longer than the plasma half-life of the reference molecule e.g. the same composition except that the albumin component (e.g. albumin, variant, fragment, fusion, conjugate or associate) is wild-type albumin (e.g. HSA) or a variant, fragment, fusion, conjugate or associate.

In a particular embodiment the compositions comprise a variant albumin or a fragment thereof according to the invention and a compound comprising a pharmaceutically beneficial moiety and an albumin binding domain (ABD). According to the invention ABD means a site, moiety or domain capable of binding to circulating albumin in vivo and thereby conferring transport in the circulation of the ABD and any compound or moiety bound to said ABD. ABD's are known in the art and have been shown to bind very tight to albumin so a compound comprising an ABD bound to albumin will to a certain extent behave as a single molecule. The inventors have realized by using the variant albumin or fragment thereof according to the invention together with a compound comprising a pharmaceutically beneficial moiety and an ABD makes it possible to alter the binding affinity to FcRn and/or plasma half-life of the compound comprising a pharmaceutically beneficial moiety and an ABD compared to the situation where said compound were injected as such in a patient having need thereof or administered in a formulation comprising natural albumin or a fragment thereof.

The variant albumin or fragments thereof, conjugates comprising variant albumin or a fragment thereof or fusion polypeptide comprising variant albumin or a fragment thereof, or an associate comprising variant albumin or a fragment thereof according to the invention may also be incorporated into nano- or microparticles using techniques well known within the art. A preferred method for preparing nano- or microparticles that may be applied to the variant albumins or fragments thereof according to the invention is disclosed in WO 2004/071536 or WO2008/007146 or Oner & Groves (Pharmaceutical Research, Vol 10 (9), 1993, pages 1387 to 1388) which are incorporated herein by reference.

Further preferences for the ninth aspect of the invention are provided below the thirteenth aspect of the invention.

Compositions

A tenth aspect of the invention relates to compositions. Therefore the invention is also directed to the use of a variant of albumin or a fragment thereof or fusion polypeptides comprising variant albumin or fragments thereof, or a conjugate comprising a variant of albumin or a fragment thereof, or an associate comprising a variant of albumin or a fragment thereof for the manufacture of a pharmaceutical composition, wherein the variant of albumin or a fragment thereof or fusion polypeptides comprising variant albumin or fragments thereof, or a conjugate comprising a variant of albumin or a fragment thereof, or an associate comprising a variant of albumin or a fragment thereof has an altered binding affinity to FcRn and/or an altered plasma half-life compared with HSA or the corresponding fragment thereof or fusion polypeptide comprising HSA or fragment thereof or conjugate comprising HSA.

In this connection the corresponding fragment of HSA is intended to mean a fragment of HSA that aligns with and has same number of amino acids as the fragment of the variant albumin with which it is compared. Similarly the corresponding fusion polypeptide comprising HSA or conjugate comprising HSA is intended to mean molecules having same size and amino acid sequence as the fusion polypeptide of conjugate comprising variant albumin, with which it is compared. Further preferences for the tenth aspect of the invention are provided below the thirteenth aspect of the invention.

Nanoparticles

An eleventh aspect of the invention relates to a nanoparticle comprising a variant, fusion, conjugate, associate, nanoparticle, composition or polynucleotide as disclosed herein.

Techniques for incorporation of a molecule into nano- or microparticles are known in the art. Preferred methods for preparing nano- or microparticles that may be applied to the albumin, variant, fragment, fusion, conjugate or associate thereof according to the invention is disclosed in WO 2004/071536 or WO2008/007146 or Oner & Groves (Pharmaceutical Research, Vol 10 (9), 1993, pages 1387 to 1388) which are incorporated herein by reference. Preferably the average diameter of a nano-particle is from 5 to 1000 nm, more preferably 5, 10, 20, 30, 40, 50, 80, 100, 130, 150, 200, 300, 400, 500, 600, 700, 800, 900, or 999 to 5, 10, 20, 30, 40, 50, 80, 100, 130, 150, 200, 300, 400, 500, 600, 700, 800, 900, or 1000 nm. An advantage of a microparticle less than 200 nm diameter, and more particularly less than 130 nm, is that is amenable to sterilisation by filtration through a 0.2 μm (micron) filter. Preferably, the average diameter of a micro-particle is from 1000 nm (1 μm (micron)) to 100 μm (micron), more preferably from 1, 2, 5, 10, 20, 30, 40, 50, 60, 70, 80, 90, 100 to 1, 2, 5, 10, 20, 30, 40, 50, 60, 70, 80, 90, 100 μm (micron).

Further preferences for the eleventh aspect of the invention are provided below the thirteenth aspect of the invention.

A twelfth aspect of the invention relates to use of a variant, fusion, conjugate, associate, nanoparticle, composition or polynucleotide as disclosed herein in a method of treatment or prophylaxis or diagnosis. In some situations, it would be advantageous to use an albumin, variant, fragment, fusion, conjugate or associate or composition thereof having a longer plasma half-life than the reference molecule or composition since this would have the benefit that the administration of the albumin, variant, fragment, fusion, conjugate or associate or composition thereof would be needed less frequently or at a reduced dose (and consequently with fewer side effects) compared to the situation where the reference molecule or composition was used. With respect to the use of a variant, fusion, conjugate, associate, nanoparticle, composition or polynucleotide the albumin moiety may comprise one more alterations as disclosed herein.

Further preferences for the twelfth aspect of the invention are provided below the thirteenth aspect of the invention.

A thirteenth aspect of the invention provides a method for altering the half-life of a molecule comprising:

(a) where the molecule is a polypeptide, fusing or conjugating the molecule to a polypeptide disclosed herein or to a conjugate disclosed herein; associating the molecule to a polypeptide disclosed herein or to a conjugate disclosed herein; incorporating the molecule in a nanoparticle disclosed herein or a composition disclosed herein;

(b) where the molecule is not a polypeptide, conjugating the molecule to a polypeptide disclosed herein or to a conjugate disclosed herein; associating the molecule to a polypeptide disclosed herein or to a conjugate a disclosed herein; incorporating the molecule in a nanoparticle disclosed herein or a composition disclosed herein.

Examples of 'molecule' include those useful in therapy, prophylaxis (including those used in vaccines either as an active pharmaceutical ingredient or as an excipient), imaging and diagnosis, such as those described herein.

Preferences for all aspects of the invention are provided below. The skilled person understands that any aspect of the invention may be combined with another aspect or aspects of the invention and/or with one or more (several) of the preferences for the aspects of the invention and/or other disclosures made herein.

The variant of albumin or a fragment thereof or fusion polypeptides comprising variant albumin or fragments thereof, fragment thereof, conjugate, nanoparticle, associate or composition may have a plasma half-life that is either longer or shorter, preferably longer, than the plasma half-life than a corresponding albumin or a fragment thereof or fusion polypeptides comprising albumin or fragments thereof, fragment thereof, conjugate, nanoparticle, associate or composition or a binding to FcRn that is stronger or weaker, preferably weaker. Preferably the variant of albumin or a fragment thereof or fusion polypeptides comprising variant albumin or fragments thereof, fragment thereof, conjugate, nanoparticle, associate or composition has a plasma half-life that is longer than the plasma half-life of HSA or the corresponding albumin or a fragment thereof or fusion polypeptides comprising albumin or fragments thereof, fragment thereof, conjugate, nanoparticle, associate or composition.

Alternatively, this may be expressed as the variant of albumin or a fragment thereof or fusion polypeptides comprising variant albumin or fragments thereof, fragment thereof, conjugate, nanoparticle, associate or composition having a KD to FcRn (e.g. shFcRn) that is lower that the corresponding KD for HSA to FcRn or the corresponding fragment thereof or fusion polypeptide comprising HSA or fragment thereof. Preferably, the KD for the variant of albumin or a fragment thereof or fusion polypeptides comprising variant albumin or fragments thereof, fragment thereof, conjugate, nanoparticle, associate or composition is less than 0.9×KD for HSA to FcRn, more preferred less than 0.5×KD for HSA to FcRn, more preferred less than 0.1×KD for HSA to FcRn, even more preferred less than 0.05×KD for HSA to FcRn, even more preferred less than 0.02×KD for HSA to FcRn and most preferred less than 0.01×KD for HSA to FcRn (where X means 'multiplied by'). The KD of the variant of albumin or a fragment thereof or fusion polypeptides comprising variant albumin or fragments thereof, fragment thereof, conjugate, nanoparticle, associate or composition may be between the KD of WT albumin (e.g. SEQ ID No. 2) for FcRn and the KD of HSA K573P (SEQ ID No. 3) for FcRn. Such KDs represent binding affinities that are higher than the binding affinity between HSA and FcRn. A higher binding affinity indicates a longer half-life, for example plasma half-life.

Alternatively, the variant of albumin or a fragment thereof or fusion polypeptides comprising variant albumin or fragments thereof, fragment thereof, conjugate, nanoparticle, associate or composition has a plasma half-life that is shorter than the plasma half-life of HSA or the corresponding fragment thereof or fusion polypeptide comprising HSA or fragment thereof.

This may be expressed as the variant of albumin or a fragment thereof or fusion polypeptides comprising variant albumin or fragments thereof, fragment thereof, conjugate, nanoparticle, associate or composition having a KD to FcRn that is higher that the corresponding KD for HSA to FcRn or the corresponding of albumin or a fragment thereof or fusion polypeptides comprising albumin or fragments thereof, fragment thereof, conjugate, nanoparticle, associate or composition. Preferably, the KD for the variant of albumin or a fragment thereof or fusion polypeptides comprising variant albumin or fragments thereof, fragment thereof, or a conjugate comprising a variant of albumin or a fragment thereof is more than 2×KD for HSA to FcRn, more preferred more than 5×KD for HSA to FcRn, more preferred more than 10×KD for HSA to FcRn, even more preferred more than 25×KD for HSA to FcRn, even most preferred more than 50×KD for HSA to FcRn. The variant of albumin or a fragment thereof or fusion polypeptides comprising variant albumin or fragments thereof, fragment thereof, conjugate, nanoparticle, associate or composition may be a null binder to FcRn.

The variant of albumin or a fragment thereof or fusion polypeptides comprising variant albumin or fragments thereof, fragment thereof, or a conjugate or nanoparticle or associate or composition comprising a variant of albumin or a fragment thereof is preferably the variant of albumin or a fragment thereof or fusion polypeptides comprising variant albumin or fragments thereof, fragment thereof, or a conjugate or nanoparticle or associate or composition comprising a variant of albumin or a fragment thereof according to the invention. A lower binding affinity indicates a shorter half-life, for example plasma half-life.

One advantage of the invention is that it allows the half-life of albumin, a variant of albumin or a fragment thereof or fusion polypeptides comprising variant albumin or fragments thereof, fragment thereof, conjugate, nanoparticle, associate or composition to be tailored in order to achieve a binding affinity or half-life which meets the needs of the user.

When determining and/or comparing KD, one or more (and preferably all) of the following parameters may be used:

Instrument: Biacore 3000 instrument (GE Healthcare)

Flow cell: CM5 sensor chip

FcRn: human FcRn, preferably soluble human FcRn, optionally coupled to a tag such as GST Quantity of FcRn: 1500-2500 RU Coupling chemistry: amine coupling chemistry (e.g. as described in the protocol provided by the manufacturer of the instrument).

Coupling method: The coupling may be performed by injecting 10 μg/ml of the protein in 10 mM sodium acetate pH 5.0 (GE Healthcare). Phosphate buffer (67 mM phosphate buffer, 0.15 M NaCl, 0.005% Tween 20) at pH 6.0) may be used as running buffer and dilution buffer. Regeneration of the surfaces may be done using injections of HBS-EP buffer (0.01 M HEPES, 0.15 M NaCl, 3 mM EDTA, 0.005% surfactant P20) at pH 7.4 (Biacore AB).

Quantity of injection of test molecule (e.g. HSA or variant) 1.0-0.5 mM

Flow rate of injection: constant, e.g. 40 μl/ml

Temperature of injection: 25° C.

Data evaluation software: BIAevaluation 4.1 software (BIAcore AB).

The invention discloses positions in SEQ ID NO: 2 (and therefore equivalent positions in albumins and fragments from human serum and albumin and non-human serum albumins) which may be altered in order to modulate (increase of decrease) the binding affinity and/or half-life e.g. plasma half-life of an albumin, fragment, fusion, conjugate, associate, nanoparticle or composition. An alteration may be a substitution, insertion or deletion. Substitution is preferred.

Figure 3:
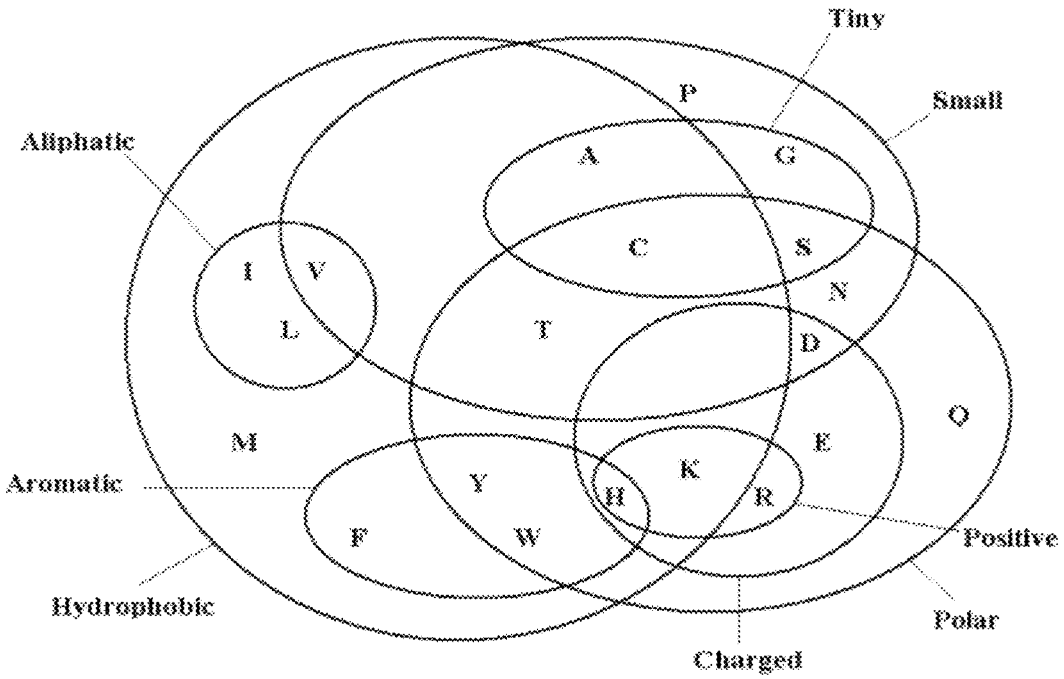
FIG. 3: Conserved groups of amino acids based on their properties.

A substitution or insertion may or may not comprise introduction of a conserved amino acid, i.e. conserved in relation to the amino acid at the position of interest. Examples of conserved amino acids are shown by the groups of FIG. 3: aliphatic, aromatic, hydrophobic, charged, polar, positive, tiny and small.

Preferred positions are those which interact with FcRn during binding and/or affect the interaction of the albumin, fragment, fusion, conjugate, associate, nanoparticle or composition with FcRn.

Preferred positions correspond to positions in SEQ ID NO: 2 selected from: (a) 492 to 538; (b) 505, 531, 524, 472, 108, 190, 197 and 425; (c) 186 to 201; (d) 457 to 472; (e) 414 to 426; (f) 104 to 120; (g) 75 to 91; (h) 144 to 150; (i) 30 to 41, (j) 550 to 585 and (k) 276, 410 and 414 with one or more (several) of A, C, D, E, F, G, H, I, K, L, M, N, P, Q, R, S, T, V, W, Y and/or a stop codon at a position from 497 to 585;

wherein, it is preferred that, when the polypeptide comprises one or more (several) alterations selected from (i) the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, (ii) the group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or (iii) the group consisting of positions 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585.

More preferred, when the polypeptide comprises one or more (several) alterations selected from (ii) the (ii) group consisting of positions 34, 38, 40, 75, 76, 80, 82, 83, 86, 90, 91, 104, 113, 115, 116, 200, 461, 471, 496, 498, 501, 503, 504, 505, 506, 512, 514, 538, 550, 558, 559, 560, 562, 564, 565, 567, 573, 574, 577, 578, 579, 580, 581, 582, 584, 585 (particularly a substitution of one or more (several) of positions 34, 38, 40, 76, 80, 82, 83, 86, 104, 113, 115, 116, 471, 496, 498, 501, 503, 504, 505, 506, 512, 538, 550, 560, 562, 564, 565, 573, 574, 577, 578, 579, 580, 581, 582, 584, 585 from the native residue (e.g. non-Cys residue) to Cys and/or a deletion of or substitution of one or more (several) of positions 91, 200, 461, 514, 558, 559, 567 from Cys, to a non-Cys residue), and/or (iii) the group consisting of positions 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 (particularly one or more of (several) D63N, E82K, E84K, D87N, L90P, K106E, R114G, E119K, V146E, H464A, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E); the polypeptide also comprises one or more (several) alterations at a position selected from group consisting of positions 30, 31, 32, 33, 35, 36, 37, 39, 41, 77, 78, 79, 81, 84, 85, 87, 88, 89, 105, 106, 107, 108, 109, 110, 111, 112, 117, 118, 120, 144, 145, 146, 147, 148, 149, 150, 186, 187, 188, 189, 190, 191, 192, 193, 194, 195, 196, 197, 198, 199, 201, 276, 410, 411, 414, 415, 416, 418, 419, 420, 421, 422, 423, 424, 425, 426, 457, 458, 459, 460, 462, 463, 465, 466, 467, 468, 469, 470, 472, 497, 502, 507, 508, 509, 511, 513, 515, 516, 517, 518, 519, 520, 521, 522, 523, 524, 525, 526, 527, 528, 529, 530, 531, 532, 534, 551, 552, 553, 554, 555, 556, 557, 561, 568, 569, 570, 571, 572, 576, 583 and/or a stop codon inserted or substituted at a position selected from 497 to 585.

According to the invention, it is preferred that when an albumin variant comprises an alteration selected from D63N, E82K, E84K, D87N, L90P, K106E, R114G, E119K, V146E, H464A, C201F, D494N, E501K, E503K, E505K, H510A, I513N, D518N, K525E, E529K, V533M, H535A, K536E, I537N, D550G, D550A, V557M, K560E, D563N, E565K, E570K, K573E, K574N, K574E, K584E, then the alteration is provided in combination with one or more (several) alterations described herein. Other alterations at one or more (several) of positions 63, 82, 84, 87, 90, 106, 114, 119, 146, 464, 201, 494, 501, 503, 505, 510, 513, 518, 525, 529, 533, 535, 536, 537, 550, 550, 557, 560, 563, 565, 570, 573, 574, 574, 584 may or may not be provided in combination with one or more (several) alterations described herein.

A stop codon may introduced at any of positions 497 to 585, i.e. any of positions 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, more preferably from 570 to 585 (or equivalent position, relative to SEQ ID NO: 2). The introduction may be made by insertion or substitution. Introduction of such a stop codon may be in addition to or instead of an alteration described herein.

For insertion of one or more (several) amino acids to the N-side ("X−1") of an amino acid at a position selected from the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, there may or may not be an additional alteration selected from the group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585.

Conversely, for insertion of one or more (several) amino acids to the C-side ("X+1") of an amino acid at a position selected from the group consisting of positions 417, 464, 492, 493, 494, 495, 496, 499, 500, 501, 503, 504, 505, 506, 510, 535, 536, 537, 538, 540, 550, 573, 574, 575, 577, 578, 579, 580, 581, 582 and 584, it is preferred that there is an additional alteration selected from the group consisting of positions 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585.

An amino acid residue of HSA interacting with FcRn is considered to be any amino acid residues of HSA being located less than 10 Å (for example less than 5 Å) from an amino acid in the FcRn or any amino acid residue that is involved in a hydrogen bond, a salt bridge or a polar or nonpolar interaction with an amino acid residue that is located less than 10 Å from an amino acid in the FcRn. Preferably the amino acid in HSA residues are located less than 10 Å from amino acids in the FcRn, more preferred less than 6 Å from amino acids in the FcRn and most preferred less than 3 Å from amino acids in the FcRn.

Preferably the amino acids residues of albumin which affect the binding of the albumin to FcRn are located in the binding surface, such as a binding surface defined in FIG. 9 (pink (in grey-scale this is seen as the darkest (almost black) region)). The amino acids may be in a part of the binding surface provided by domain I or in a part of the binding surface provided by domain III of albumin.

Therefore the one or more (several) alterations may be in domain I, e.g. at positions selected from the group consisting of 30 to 41, 75 to 91, 104 to 120, 144 to 150, 186 to 201. The one or more alterations may be in domain II, e.g. position 276. The one or more alterations may be in domain III, e.g. at positions selected from the group consisting of 414 to 426, 457 to 472, 492-538, 550 to 585.

Positions 83, 108, 109, 110, 111, 112, 105 to 120, 190, 197, 425, 472, 505, 510, 524, 527, 531, 534, are particularly preferred.

Advantageously, the polypeptide retains substantially the same tertiary structure (or, for a fragment, the relevant part of the structure) as a reference or parent albumin such as HSA. The skilled person understand the term 'substantially the same tertiary structure' bearing in mind that some degree of variation in tertiary structure is expected as all proteins have some degree of structural flexibility. This applies particularly to polypeptides have a higher binding affinity to FcRn than the parent or reference albumin (e.g. HSA) has to FcRn.

One or more of the His residues may or may not be maintained relative to the parent albumin. For example, with reference to SEQ ID NO: 2, one or more of the following His residues may be maintained: 3, 9, 39, 67, 105, 128, 146, 242, 247, 288, 338, 367, 440, 464, 510, 535. One or more, preferably all, of the His residues in domain I are maintained (i.e. 3, 9, 39, 67, 105, 128, 146). One or more, preferably all, of the His residues in domain II are maintained (i.e. 242, 247, 288, 338, 367). One or more, preferably all, of the His residues in domain III are maintained (i.e. 440, 464, 510, 535). One or more or all three of His 464, 510, 535 may be maintained.

It is preferred that at least 1, 2, 3, 4, 5, 6, 7, 8, 9, 10, 11, 12, 13, 14, 15, 16 or 17 of the disulphide bonds of the albumin are maintained in the polypeptide. For a polypeptide derived from a full length albumin, it is preferred that all disulphide bonds usually present in that albumin are maintained. For a polypeptide derived from a fragment of albumin, it is preferred that all disulphide bonds usually present in that fragment are maintained. It is preferred that Cys-34 (or equivalent in non-human albumins) is maintained.

When the alteration is at a position selected from one or more (several) of 75, 90, 91, 200, 461, 514, 558, 559 and 567, it is preferred that there is also one or more (several) alterations at a position selected from group consisting of 30, 31, 32, 33, 34, 35, 36, 37, 38, 39, 40, 41, 75, 76, 77, 78, 79, 80, 81, 82, 83, 84, 85, 86, 87, 88, 89, 90, 91, 104, 105, 106, 107, 108, 109, 110, 111, 112, 113, 114, 115, 116, 117, 118, 119, 120, 144, 145, 146, 147, 148, 149, 150, 186, 187, 188, 189, 190, 191, 192, 193, 194, 195, 196, 197, 198, 199, 200, 201, 276, 410, 411, 414, 415, 416, 418, 419, 420, 421, 422, 423, 424, 425, 426, 457, 458, 459, 460, 461, 462, 463, 465, 466, 467, 468, 469, 470, 471, 472, 497, 498, 502, 507, 508, 509, 511, 512, 513, 514, 515, 516, 517, 518, 519, 520, 521, 522, 523, 524, 525, 526, 527, 528, 529, 530, 531, 532, 533, 534, 551, 552, 553, 554, 555, 556, 557, 558, 559, 560, 561, 562, 563, 564, 565, 567, 568, 569, 570, 571, 572, 576, 583, 585 and/or a stop codon inserted or substituted at a position selected from 497 to 585.

For a polypeptide, particularly a polypeptide comprising a single alteration, it is preferred that an alteration does not comprise substitution with a Cys, insertion of a Cys and/or deletion of a residue which disrupts a disulphide bond and therefore provides an additional conjugatable Cys within the polypeptide. It is particularly preferred that the alteration(s) at one or more (several) of positions 75, 90, 91, 200, 461, 514, 558, 559 and 567 is not a substitution from Cys to any other amino acid (A, D, E, F, G, H, I, K, L, M, N, P, Q, R, S, T, V, W, Y), is not deletion of the Cys, is not substitution or deletion of the disulphide binding partner of that Cys, therefore preferably Cys at one more of positions 53, 62, 75, 90, 91, 101, 124, 168, 169, 177, 200, 245, 246, 253, 265, 278, 279, 289, 316, 360, 361, 369, 392, 437, 438, 448, 461, 476, 477, 487, 514, 558, 559, 567 are not deleted, substituted and/or subjected to an insertion. Most preferably, no Cys usually involved in disulphide binding is deleted, substituted and/or subjected to an insertion. Therefore, it is preferred that if an alteration is at one or more (several) of positions 34, 38, 40, 76, 79, 80, 82, 83, 86, 104, 113, 115, 116, 471, 490, 496, 498, 501, 503, 504, 505, 506, 512, 538, 542, 550, 560, 562, 564, 565, 573, 574, 577, 578, 579, 580, 581, 582, 584, 585, the alteration is not a substitution to Cys and/or an insertion of a Cys.

For all aspects of the invention, it is preferred that position 573 (or equivalent thereof) is a Pro, Trp or Tyr residue. Therefore, when there are 2 or more (several) alterations, it is preferred that position 573 (or equivalent thereof) is Pro, Trp or Tyr.

For all aspects of the invention fusion partner polypeptides and/or conjugates may comprise one or more (several) of: 4-1BB ligand, 5-helix, A human C-C chemokine, A human L105 chemokine, A human L105 chemokine designated huL105_3, A monokine induced by gamma-interferon (MIG), A partial CXCR4B protein, A platelet basic protein (PBP), α1-antitrypsin, ACRP-30 Homologue; Complement Component C1q C, Adenoid-expressed chemokine (ADEC), aFGF; FGF-1, AGF, AGF Protein, albumin, an etoposide, angiostatin, Anthrax vaccine, Antibodies specific for collapsin, antistasin, Anti-TGF beta family antibodies, antithrombin III, APM-1; ACRP-30; Famoxin, apo-lipoprotein species, Arylsulfatase B, b57 Protein, BCMA, Beta-thromboglobulin protein (beta-TG), bFGF; FGF2, Blood coagulation factors, BMP Processing Enzyme Furin, BMP-10, BMP-12, BMP-15, BMP-17, BMP-18, BMP-2B, BMP-4, BMP-5, BMP-6, BMP-9, Bone Morphogenic Protein-2, calcitonin, Calpain-10a, Calpain-10b, Calpain-10c, Cancer Vaccine, Carboxypeptidase, C-C chemokine, MCP2, CCR5 variant, CCR7, CCR7, CD11a Mab, CD137; 4-1BB Receptor Protein, CD20 Mab, CD27, CD27L, CD30, CD30 ligand, CD33 immunotoxin, CD40, CD40L, CD52 Mab, Cerebus Protein, Chemokine Eotaxin, Chemokine hIL-8, Chemokine hMCP1, Chemokine hMCP1a, Chemokine hMCP1b, Chemokine hMCP2, Chemokine hMCP3, Chemokine hSDF1b, Chemokine MCP-4, chemokine TECK and TECK variant, Chemokine-like protein IL-8M1 Full-Length and Mature, Chemokine-like protein IL-8M10 Full-Length and Mature, Chemokine-like protein IL-8M3, Chemokine-like protein IL-8M8 Full-Length and Mature, Chemokine-like protein IL-8M9 Full-Length and Mature, Chemokine-like protein PF4-414 Full-Length and Mature, Chemokine-like protein PF4-426 Full-Length and Mature, Chemokine-like protein PF4-M2 Full-Length and Mature, Cholera vaccine, Chondromodulin-like protein, c-kit ligand; SCF; Mast cell growth factor; MGF; Fibrosarcoma-derived stem cell factor, CNTF and fragment thereof (such as CNTFAx15' (Axokine™)), coagulation factors in both pre and active forms, collagens, Complement C5 Mab, Connective tissue activating protein-III, CTAA16.88 Mab, CTAP-III, CTLA4-Ig, CTLA-8, CXC3, CXC3, CXCR3; CXC chemokine receptor 3, cyanovirin-N, Darbepoetin, designated exodus, designated huL105_7, DIL-40, DNase, EDAR, EGF Receptor Mab, ENA-78, Endostatin, Eotaxin, Epithelial neutrophil activating protein-78, EPO receptor; EPOR, erythropoietin (EPO) and EPO mimics, Eutropin, Exodus protein, Factor IX, Factor VII, Factor VIII, Factor X and Factor XIII, FAS Ligand Inhibitory Protein (DcR3), FasL, FasL, FasL, FGF, FGF-12; Fibroblast growth factor homologous factor-1, FGF-15, FGF-16, FGF-18, FGF-3; INT-2, FGF-4; gelonin, HST-1; HBGF-4, FGF-5, FGF-6; Heparin binding secreted transforming factor-2, FGF-8, FGF-9; Glia activating factor, fibrinogen, flt-1, flt-3 ligand, Follicle stimulating hormone Alpha subunit, Follicle stimulating hormone Beta subunit, Follitropin, Fractalkine, fragment. myofibrillar protein Troponin I, FSH, Galactosidase, Galectin-4, G-CSF, GDF-1, Gene therapy, Glioma-derived growth factor, glucagon, glucagon-like peptides, Glucocerebrosidase, glucose oxidase, Glucosidase, Glycodelin-A; Progesterone-associated endometrial protein, GM-CSF, gonadotropin, Granulocyte chemotactic protein-2 (GCP-2), Granulocyte-macrophage colony stimulating factor, growth hormone, Growth related oncogene-alpha (GRO-alpha), Growth related oncogene-beta (GRO-beta), Growth related oncogene-gamma (GRO-gamma), hAPO-4; TROY, hCG, Hepatitus B surface Antigen, Hepatitus B Vaccine, HER2Receptor Mab, hirudin, HIV gp120, HIV gp41, HIV Inhibitor Peptide, HIV Inhibitor Peptide, HIV Inhibitor Peptide, HIV protease inhibiting peptides, HIV-1 protease inhibitors, HPV vaccine, Human 6CKine protein, Human Act-2 protein, Human adipogenesis inhibitory factor, human B cell stimulating factor-2 receptor, Human beta-chemokine H1305 (MCP-2), Human C-C chemokine DGWCC, Human CC chemokine ELC protein, Human CC type chemokine interleukin C, Human CCC3 protein, Human CCF18 chemokine, Human CC-type chemokine protein designated SLC (secondary lymphoid chemokine), Human chemokine beta-8 short forms, Human chemokine C10, Human chemokine CC-2, Human chemokine CC-3, Human chemokine CCR-2, Human chemokine Ckbeta-7, Human chemokine ENA-78, Human chemokine eotaxin, Human chemokine GRO alpha, Human chemokine GROalpha, Human chemokine GRObeta, Human chemokine HCC-1, Human chemokine HCC-1, Human chemokine I-309, Human chemokine IP-10, Human chemokine L105_3, Human chemokine L105_7, Human chemokine MIG, Human chemokine MIG-beta protein, Human chemokine MIP-1alpha, Human chemokine MIP1beta, Human chemokine MIP-3alpha, Human chemokine MIP-3beta, Human chemokine PF4, Human chemokine protein 331D5, Human chemokine protein 61164, Human chemokine receptor CXCR3, Human chemokine SDF1alpha, Human chemokine SDF1 beta, Human chemokine ZSIG-35, Human Chr19Kine protein, Human CKbeta-9, Human CKbeta-9, Human CX3C 111 amino acid chemokine, Human DNAX interleukin-40, Human DVic-1 C-C chemokine, Human EDIRF I protein sequence, Human EDIRF II protein sequence, Human eosinocyte CC type chemokine eotaxin, Human eosinophil-expressed chemokine (EEC), Human fast twitch skeletal muscle troponin C, Human fast twitch skeletal muscle troponin I, Human fast twitch skeletal muscle Troponin subunit C, Human fast twitch skeletal muscle Troponin subunit I Protein, Human fast twitch skeletal muscle Troponin subunit T, Human fast twitch skeletal muscle troponin T, Human foetal spleen expressed chemokine, FSEC, Human GM-CSF receptor, Human gro-alpha chemokine, Human gro-beta chemokine, Human gro-gamma chemokine, Human IL-16 protein, Human IL-1RD10 protein sequence, Human IL-1 RD9, Human IL-5 receptor alpha chain, Human IL-6 receptor, Human IL-8 receptor protein hIL8RA, Human IL-8 receptor protein hIL8RB, Human IL-9 receptor protein, Human IL-9 receptor protein variant #3, Human IL-9 receptor protein variant fragment, Human IL-9 receptor protein variant fragment#3, Human interleukin 1 delta, Human Interleukin 10, Human Interleukin 10, Human interleukin 18, Human interleukin 18 derivatives, Human interleukin-1 beta precursor, Human interleukin-1 beta precursor, Human interleukin-1 receptor accessory protein, Human interleukin-1 receptor antagonist beta, Human interleukin-1 type-3 receptor, Human Interleukin-10 (precursor), Human Interleukin-10 (precursor), Human interleukin-11 receptor, Human interleukin-12 40 kD subunit, Human interleukin-12 beta-1 receptor, Human interleukin-12 beta-2 receptor, Human Interleukin-12 p35 protein, Human Interleukin-12 p40 protein, Human interleukin-12 receptor, Human interleukin-13 alpha receptor, Human interleukin-13 beta receptor, Human interleukin-15, Human interleukin-15 receptor from clone P1, Human interleukin-17 receptor, Human interleukin-18 protein (IL-18), Human interleukin-3, human interleukin-3 receptor, Human interleukin-3 variant, Human interleukin-4 receptor, Human interleukin-5, Human interleukin-6, Human interleukin-7, Human interleukin-7, Human interleukin-8 (IL-8), Human intracellular IL-1 receptor antagonist, Human IP-10 and HIV-1 gp120 hypervariable region fusion protein, Human IP-10 and human Muc-1 core epitope (VNT) fusion protein, human liver and activation regulated chemokine (LARC), Human Lkn-1 Full-Length and Mature protein, Human mammary associated chemokine (MACK) protein Full-Length and Mature, Human mature chemokine Ckbeta-7, Human mature gro-alpha, Human mature gro-gamma polypeptide used to treat sepsis, Human MCP-3 and human Muc-1 core epitope (VNT) fusion protein, Human MI10 protein, Human MI1A protein, Human monocyte chemoattractant factor hMCP-1, Human monocyte chemoattractant factor hMCP-3, Human monocyte chemotactic proprotein (MCPP) sequence, Human neurotactin chemokine like domain, Human non-ELR CXC chemokine H174, Human non-ELR CXC chemokine IP10, Human non-ELR CXC chemokine Mig, Human PAI-1 mutants, Human protein with IL-16 activity, Human protein with IL-16 activity, Human secondary lymphoid chemokine (SLC), Human SISD protein, Human STCP-1, Human stromal cell-derived chemokine, SDF-1, Human T cell mixed lymphocyte reaction expressed chemokine (TMEC), Human thymus and activation regulated cytokine (TARC), Human thymus expressed, Human TNF-alpha, Human TNF-alpha, Human TNF-beta (LT-alpha), Human type CC chemokine eotaxin 3 protein sequence, Human type II interleukin-1 receptor, Human wild-type interleukin-4 (hIL-4) protein, Human ZCHEMO-8 protein, Humanized Anti-VEGF Antibodies, and fragments thereof, Humanized Anti-VEGF Antibodies, and fragments thereof, Hyaluronidase, ICE 10 kD subunit, ICE 20 kD subunit, ICE 22 kD subunit, Iduronate-2-sulfatase, Iduronidase, IL-1 alpha, IL-1 beta, IL-1 inhibitor (IL-1i), IL-1 mature, IL-10 receptor, IL-11, IL-11, IL-12 p40 subunit, IL-13, IL-14, IL-15, IL-15 receptor, IL-17, IL-17 receptor, Il-17 receptor, Il-17 receptor, IL-19, IL-1i fragments, IL1-receptor antagonist, IL-21 (TIF), IL-3 containing fusion protein, IL-3 mutant proteins, IL-3 variants, IL-3 variants, IL-4, IL-4 mutein, IL-4 mutein Y124G, IL-4 mutein Y124X, IL-4 muteins, IL-5 receptor, IL-6, Il-6 receptor, IL-7 receptor clone, IL-8 receptor, IL-9 mature protein variant (Met117 version), immunoglobulins or immunoglobulin-based molecules or fragment of either (e.g. a Small Modular ImmunoPharmaceutical™ ("SMIP") or dAb, Fab' fragments, F(ab')2, scAb, scFv or scFv fragment), including but not limited to plasminogen, Influenza Vaccine, Inhibin alpha, Inhibin beta, insulin, insulin-like growth factor, Integrin Mab, inter-alpha trypsin inhibitor, inter-alpha trypsin inhibitor, Interferon gamma-inducible protein (IP-10), interferons (such as interferon alpha species and sub-species, interferon beta species and sub-species, interferon gamma species and sub-species), interferons (such as interferon alpha species and sub-species, interferon beta species and sub-species, interferon gamma species and sub-species), Interleukin 6, Interleukin 8 (IL-8) receptor, Interleukin 8 receptor B, Interleukin-1alpha, Interleukin-2 receptor associated protein p43, interleukin-3, interleukin-4 muteins, Interleukin-8 (IL-8) protein, interleukin-9, Interleukin-9 (IL-9) mature protein (Thr117 version), interleukins (such as IL0, IL11 and IL2), interleukins (such as IL0, IL11 and IL2), Japanese encephalitis vaccine, Kalikrein Inhibitor, Keratinocyte growth factor, Kunitz domain protein (such as aprotinin, amyloid precursor protein and those described in WO 03/066824, with or without albumin fusions), Kunitz domain protein (such as aprotinin, amyloid precursor protein and those described in WO 03/066824, with or without albumin fusions), LACI, lactoferrin, Latent TGF-beta binding protein II, leptin, Liver expressed chemokine-1 (LVEC-1), Liver expressed chemokine-2 (LVEC-2), LT-alpha, LT-beta, Luteinization Hormone, Lyme Vaccine, Lymphotactin, Macrophage derived chemokine analogue MDC (n+1), Macrophage derived chemokine analogue MDC-eyfy, Macrophage derived chemokine analogue MDC-yl, Macrophage derived chemokine, MDC, Macrophage-derived chemokine (MDC), Maspin; Protease Inhibitor 5, MCP-1 receptor, MCP-1a, MCP-1b, MCP-3, MCP-4 receptor, M-CSF, Melanoma inhibiting protein, Membrane-bound proteins, Met117 human interleukin 9, MIP-3 alpha, MIP-3 beta, MIP-Gamma, MIRAP, Modified Rantes, monoclonal antibody, MP52, Mutant Interleukin 6 S176R, myofibrillar contractile protein Troponin I, Natriuretic Peptide, Nerve Growth Factor-beta, Nerve Growth Factor-beta2, Neuropilin-1, Neuropilin-2, Neurotactin, Neurotrophin-3, Neurotrophin-4, Neurotrophin-4-a, Neurotrophin-4-b, Neurotrophin-4-c, Neurotrophin-4-d, Neutrophil activating peptide-2 (NAP-2), NOGO-66 Receptor, NOGO-A, NOGO-B, NOGO-C, Novel beta-chemokine designated PTEC, N-terminal modified chemokine GroHEK/hSDF-1 alpha, N-terminal modified chemokine GroHEK/hSDF-1beta., N-terminal modified chemokine met-hSDF-1 alpha, N-terminal modified chemokine met-hSDF-1 beta, OPGL, Osteogenic Protein-1; OP-1; BMP-7, Osteogenic Protein-2, OX40; ACT-4, OX40L, Oxytocin (Neurophysin I), parathyroid hormone, Patched, Patched-2, PDGF-D, Pertussis toxoid, Pituitary expressed chemokine (PGEC), Placental Growth Factor, Placental Growth Factor-2, Plasminogen Activator Inhibitor-1; PAI-1, Plasminogen Activator Inhibitor-2; PAI-2, Plasminogen Activator Inhibitor-2; PAI-2, Platelet derived growth factor, Platelet derived growth factor Bv-sis, Platelet derived growth factor precursor A, Platelet derived growth factor precursor B, Platelet Mab, platelet-derived endothelial cell growth factor (PD-ECGF), Platelet-Derived Growth Factor A chain, Platelet-Derived Growth Factor B chain, polypeptide used to treat sepsis, Preproapolipoprotein "milano" variant, Preproapolipoprotein "paris" variant, pre-thrombin, Primate CC chemokine "ILINCK", Primate CXC chemokine "IBICK", proinsulin, Prolactin, Prolactin2, prosaptide, Protease inhibitor peptides, Protein C, Protein S, pro-thrombin, prourokinase, RANTES, RANTES 8-68, RANTES 9-68, RANTES peptide, RANTES receptor, Recombinant interleukin-16, Resistin, restrictocin, Retroviral protease inhibitors, ricin, Rotavirus Vaccine, RSV Mab, saporin, sarcin, Secreted and Transmembrane polypeptides, Secreted and Transmembrane polypeptides, serum cholinesterase, serum protein (such as a blood clotting factor), Soluble BMP Receptor Kinase Protein-3, Soluble VEGF Receptor, Stem Cell Inhibitory Factor, Straphylococcus Vaccine, Stromal Derived Factor-1 alpha, Stromal Derived Factor-1 beta, Substance P (tachykinin), T1249 peptide, T20 peptide, T4 Endonuclease, TACI, Tarc, TGF-beta 1, TGF-beta 2, Thr117 human interleukin 9, thrombin, thrombopoietin, Thrombopoietin derivative1, Thrombopoietin derivative2, Thrombopoietin derivative3, Thrombopoietin derivative4, Thrombopoietin derivative5, Thrombopoietin derivative6, Thrombopoietin derivative7, Thymus expressed chemokine (TECK), Thyroid stimulating Hormone, tick anticoagulant peptide, Tim-1 protein, TNF-alpha precursor, TNF-R, TNF-RII; TNF p75 Receptor; Death Receptor, tPA, transferrin, transforming growth factor beta, Troponin peptides, Truncated monocyte chemotactic protein 2 (6-76), Truncated monocyte chemotactic protein 2 (6-76), Truncated RANTES protein (3-68), tumour necrosis factor, Urate Oxidase, urokinase, Vasopressin (Neurophysin II), VEGF R-3; flt-4, VEGF Receptor; KDR; flk-1, VEGF-110, VEGF-121, VEGF-138, VEGF-145, VEGF-162, VEGF-165, VEGF-182, VEGF-189, VEGF-206, VEGF-D, VEGF-E; VEGF-X, von Willebrand's factor, Wild type monocyte chemotactic protein 2, Wild type monocyte chemotactic protein 2, ZTGF-beta 9, alternative antibody scaffolds e.g. anticalin(s), adnectin(s), fibrinogen fragment(s), nanobodies such as camelid nanobodies, infestin, and/or any of the molecules mentioned in WO01/79271 (particularly page 9 and/or Table 1), WO 2003/59934 (particularly Table 1), WO03/060071 (particularly Table 1) or WO01/079480 (particularly Table 1) (each incorporated herein by reference in their entirety).

Furthermore, conjugates may comprise one or more (several) of chemotherapy drugs such as: 13-cis-Retinoic Acid, 2-CdA, 2-Chlorodeoxyadenosine, 5-Azacitidine, 5-Fluorouracil, 5-FU, 6-Mercaptopurine, 6-MP, 6-TG, 6-Thioguanine, A, Abraxane, Accutane®, Actinomycin-D, Adriamycin®, Adrucil®, Agrylin®, Ala-Cort®, Aldesleukin, Alemtuzumab, ALIMTA, Alitretinoin, Alkaban-AQ®, Alkeran®, All-transretinoic Acid, Alpha Interferon, Altretamine, Amethopterin, Amifostine, Aminoglutethimide, Anagrelide, Anandron®, Anastrozole, Arabinosylcytosine, Ara-C, Aranesp®, Aredia®, Arimidex®, Aromasin®, Arranon®, Arsenic Trioxide, Asparaginase, ATRA, Avastin®, Azacitidine, BCG, BCNU, Bevacizumab, Bexarotene, BEXXAR®, Bicalutamide, BiCNU, Blenoxane®, Bleomycin, Bortezomib, Busulfan, Busulfex®, C225, Calcium Leucovorin, Campath®, Camptosar®, Camptothecin-11, Capecitabine, Carac™, Carboplatin, Carmustine, Carmustine Wafer, Casodex®, CC-5013, CCNU, CDDP, CeeNU, Cerubidine®, Cetuximab, Chlorambucil, Cisplatin, Citrovorum Factor, Cladribine, Cortisone, Cosmegen®, CPT-11, Cyclophosphamide, Cytadren®, Cytarabine, Cytarabine Liposomal, Cytosar-U®, Cytoxan®, Dacarbazine, Dacogen, Dactinomycin, Darbepoetin Alfa, Dasatinib, Daunomycin, Daunorubicin, Daunorubicin Hydrochloride, Daunorubicin Liposomal, DaunoXome®, Decadron, Decitabine, Delta-Cortef®, Deltasone®, Denileukin diftitox, DepoCyt™, Dexamethasone, Dexamethasone acetate, Dexamethasone Sodium Phosphate, Dexasone, Dexrazoxane, DHAD, DIC, Diodex, Docetaxel, Doxil®, Doxorubicin, Doxorubicin liposomal, Droxia™, DTIC, DTIC-Dome®, Duralone®, Efudex®, Eligard™, Ellence™, Eloxatin™, Elspar®, Emcyt®, Epirubicin, Epoetin alfa, Erbitux™, Erlotinib, *Erwinia* L-asparaginase, Estramustine, Ethyol, Etopophos®, Etoposide, Etoposide Phosphate, Eulexin®, Evista®, Exemestane, Fareston®, Faslodex®, Ferrara®, Filgrastim, Floxuridine, Fludara®, Fludarabine, Fluoroplex®, Fluorouracil, Fluorouracil (cream), Fluoxymesterone, Flutamide, Folinic Acid, FUDR®, Fulvestrant, G-CSF, Gefitinib, Gemcitabine, Gemtuzumab ozogamicin, Gemzar®, Gleevec™, Gliadel® Wafer, GM-CSF, Goserelin, Granulocyte—Colony Stimulating Factor, Granulocyte Macrophage Colony Stimulating Factor, Halotestin®, Herceptin®, Hexadrol, Hexylen®, Hexamethylmelamine, HMM, Hycamtin®, Hydrea®, Hydrocort Acetate®, Hydrocortisone, Hydrocortisone Sodium Phosphate, Hydrocortisone Sodium Succinate, Hydrocortone Phosphate, Hydroxyurea, Ibritumomab, Ibritumomab Tiuxetan, Idamycin®, Idarubicin, Ifex®, IFN-alpha, Ifosfamide, IL-11, IL-2, Imatinib mesylate, Imidazole Carboxamide, Interferon alfa, Interferon Alfa-2b (PEG Conjugate), Interleukin-2, Interleukin-11, Intron A® (interferon alfa-2b), Iressa®, Irinotecan, Isotretinoin, Kidrolase®, Lanacort®, Lapatinib, L-asparaginase, LCR, Lenalidomide, Letrozole, Leucovorin, Leukeran, Leukine™, Leuprolide, Leurocristine, Leustatin™, Liposomal Ara-C, Liquid Pred®, Lomustine, L-PAM, L-Sarcolysin, Lupron®, Lupron Depot®, M, Matulane®, Maxidex, Mechlorethamine, Mechlorethamine Hydrochloride, Medralone®, Medrol®, Megace®, Megestrol, Megestrol Acetate, Melphalan, Mercaptopurine, Mesna, Mesnex™, Methotrexate, Methotrexate Sodium, Methylprednisolone, Meticorten®, Mitomycin, Mitomycin-C, Mitoxantrone, M-Prednisol®, MTC, MTX, Mustargen®, Mustine, Mutamycin®, Myleran®, Mylocel™, Mylotarg®, Navelbine®, Nelarabine, Neosar®, Neulasta™, Neumega®, Neupogen®, Nexavar®, Nilandron®, Nilutamide, Nipent®, Nitrogen Mustard, Novaldex®, Novantrone®, Octreotide, Octreotide acetate, Oncospar®, Oncovin®, Ontak®, Onxal™, Oprevelkin, Orapred®, Orasone®, Oxaliplatin, a taxol or taxol derivative e.g. Paclitaxel or Paclitaxel Protein-bound, Pamidronate, Panitumumab, Panretin®, Paraplatin®, Pediapred®, PEG Interferon, Pegaspargase, Pegfilgrastim, PEG-INTRON™, PEG-L-asparaginase, PEMETREXED, Pentostatin, Phenylalanine Mustard, Platinol®, Platinol-AQ®, Prednisolone, Prednisone, Prelone®, Procarbazine, PROCRIT®, Proleukin®, Prolifeprospan 20 with Carmustine Implant, Purinethol®, R, Raloxifene, Revlimid®, Rheumatrex®, Rituxan®, Rituximab, Roferon-A® (Interferon Alfa-2a), Rubex®, Rubidomycin hydrochloride, Sandostatin®, Sandostatin LAR®, Sargramostim, Solu-Cortef®, Solu-Medrol®, Sorafenib, SPRYCEL™, STI-571, Streptozocin, SU11248, Sunitinib, Sutent®, Tamoxifen, Tarceva®, Targretin®, Taxol®, Taxotere®, Temodar®, Temozolomide, Teniposide, TESPA, Thalidomide, Thalomid®, TheraCys®, Thioguanine, Thioguanine Tabloid®, Thiophosphoamide, Thioplex®, Thiotepa, TICE®, Toposar®, Topotecan, Toremifene, Tositumomab, Trastuzumab, Tretinoin, Trexall™, Trisenox®, TSPA, TYKERB®, VCR, Vectibix™, Velban®, Velcade®, VePesid®, Vesanoid®, Viadur™, Vidaza®, Vinblastine, Vinblastine Sulfate, Vincasar Pfs®, Vincristine, Vinorelbine, Vinorelbine tartrate, VLB, VM-26, Vorinostat, VP-16, Vumon®, Xeloda®, Zanosar®, Zevalin™, Zinecard®, Zoladex®, Zoledronic acid, Zolinza, Zometa®; radiopharmaceuticals such as: Carbon-11, Carbon-14, Chromium-51, Cobalt-57, Cobalt-58, Erbium-169, Fluorine-18, Gallium-67, Gold-198, Indium-111, Indium-113m, Iodine-123, Iodine-125, Iodine-131, Iron-59, Krypton-81m, Nitrogen-13, Oxygen-15, Phosphorous-32, Rhenium-186, Rubidium-82, Samarium-153, Selenium-75, Strontium-89, Technetium-99m, Thallium-201, Tritium, Xenon-127, Xenon-133, Yttrium-90; imaging agents such as Gadolinium, magnetite, manganese, technetium, I125, I131, P32, TI1201, Iopamidol, PET-FDG.

Further fusion partners, conjugation partners and/or molecules for inclusion in a nanoparticle, associate or composition according to the invention include: acromegaly drugs e.g. somatuline, lanreotide, octreotide, Sandostatin; antithrombotics e.g. bivalirudin, Angiomax, dalteparin, Fragmin, enoxaparin, Lovenox, Drotrecogin alfa (e.g. Activated), Xigris, heparin; assisted reproductive therapy compounds e.g. choriogonadotropin, Ovidrel, follitropin, alpha/beta; enzymes e.g. hyaluronidase, Hylenex; diabetes drugs e.g. exenatide, Byetta, glucagon, insulin, liraglutide, albiglutide, GLP-1 agonists, exendin or an exendin analog; compounds useful in diagnosis e.g. protirelin, Thyrel TRH Thypinone, secretin (e.g. synthetic human), Chirhostim, thyrotropin (e.g. alpha), Thyrogen' erythropoiesis drugs e.g. Darbepoetin alfa, Aranesp, Epoetin alfa, Epogen, Eprex, drugs for the treatment of genetic defects e.g. pegademase, drugs for the treatment of growth failure e.g. Adagen, mecasermin, rinfabate, drugs for the treatment of cystic fibrosis e.g. Dornase alfa, Pulmozyme, drugs for the treatment of metaoblic disorders e.g. Agalsidase beta, Fabrazyme, alglucosidase alpha, Myozyme, Laronidase, Aldurazyme, drugs for the treatment of genital wart intralesional e.g. Interferon alfa-n3, Alferon N, drugs for the treatment of granulomatous disease e.g. Interferon gamma-1b, Actimmune; drugs for the treatment of growth failure e.g. pegvisomant, Somavert, somatropin, Genotropin, Nutropin, Humatrope, Serostim, Protropin; drugs for the treatment of heart failure e.g. nesiritide, Natrecor; drugs for the treatment of hemophilia e.g. a coagulation factor e.g. Factor VIII, Helixate FS, Kogenate FS, Factor IX, BeneFIX, Factor VIIa, Novoseven, desmopressin, Stimate, DDAVP; hemopoetic drugs e.g. Filgrastim (G-CSF), Neupogen, Oprelvekin, Neumega, Pegfilgrastim, Neulasta, Sargramostim, Leukine; drugs for the treatment of hepatitis C e.g. Interferon alfa-2a, Roferon A, Interferon alfa-2b, Intron A, Interferon alfacon-1, Infergen, Peginterferon alfa-2a, Pegasys, Peginterferon alfa-2b, PEG-Intron; drugs for the treatment of HIV e.g. enfuvirtide, Fuzeon; Fabs e.g. Fab (antithrombin), Abciximab, ReoPro; monoclonal antibodies e.g. Daclizumab, Zenapax; antiviral monoclonal antibodies e.g. Palivizumab, Synagis; monoclonal antibodies for the treatment of asthma e.g. Omalizumab, Xolair; monoclonal antibodies for use in diagnostic imaging e.g. Arcitumomab, CEA-Scan, Capromab Pendetide, ProstaScint, Satumomab Pendetide, OncoScint CR/OV, Fabs for use in diagnostic imaging e.g. Nofetumomab, Verluma; iimmuno-supressant monoclonal antibodies e.g. Basiliximab, Simulect, Muromonab-CD3, Orthoclone OKT3; monoclonal antibodies for the treatment of malignancy e.g. Alemtuzumab, Campath, Ibritumomab tiuxetan, Zevalin, Rituximab, Rituxan, Trastuzumab, Herceptin; monoclonal antibodies for the treatment of rheumatoid arthritis (RA) e.g. Adalimumab, Humira, Infliximab, Remicade; monoclonal antibodies for use as a radio-immuno-therapeutic e.g. Tositumomab and Iodine $I^{131}$, Tositumomab, Bexxar; drugs for the treatment of macular degeneration e.g. pegaptanib, Macugen; drugs for the treatment of malignancy e.g. Aldesleukin, Proleukin, Interleukin-2, Asparaginase, Elspar, Rasburicase, Elitek, Denileukin diftitox, Ontak, Pegaspargase, Oncaspar, goserelin, leuprolide; drugs for the treatment of multiple sclerosis (MS) e.g. Glatiramer acetate (e.g. copolymer-1), Copaxone, Interferon beta-1a, Avonex, Interferon beta-1a, Rebif, Interferon beta-1b, Betaseron; drugs for the treatment of mucositis e.g. palifermin, Kepivance; drug for the treatment of dystonia e.g., neurotoxin, Botulinum Toxin Type A, BOTOX, BOTOX Cosmetic, Botulinum Toxin Type B, MYOBLOC; drugs for the treatment of osteoporosis e.g. teriparatide, Forteo; drugs for the treatment of psoriasis e.g. Alefacept, Amevive; drugs for the treatment of RA e.g. abatacept, Orencia, Anakinra, Kineret, Etanercept, Enbrel; thrombolytics e.g. Alteplase, Activase, rtPA, Anistreplase, Eminase, Reteplase, Retavase, Streptokinase, Streptase, Tenecteplase, TNKase, Urokinase, Abbokinase, Kinlytic; drugs for the treatment of osteoporosis e.g. calcitonin (e.g. salmon), Miacalcin, Fortical, drugs for the treatment of skin ulcers e.g. Becaplermin, Regranex, Collagenase, Santyl.

Such polypeptides and chemical compounds may be referred to as diagnostic moieties, therapeutic moieties, prophylactic moieties or beneficial moieties.

Preferably the fusion partner and/or conjugation partner is not an albumin, variant or fragment thereof.

One or more (several) therapeutic or prophylactic polypeptides may be fused to the N-terminus, the C-terminus of albumin, inserted into a loop in the albumin structure or any combination thereof. It may or it may not comprise linker sequences separating the various components of the fusion polypeptide.

Teachings relating to fusions of albumin or a fragment thereof are known in the art and the skilled person will appreciate that such teachings can also be applied to the invention. WO 2001/79271A and WO 2003/59934A (incorporated herein by reference) also contain examples of therapeutic and prophylactic polypeptides that may be fused to albumin or fragments thereof, and these examples apply also to the invention.

The invention is further described by the following examples that should not be construed as limiting the scope of the invention.

EXAMPLES

Materials and Methods

Production of HSA Mutants and Hybrid Molecules Including Generation of C-Terminal Truncations of Albumin.

Variants of albumin were prepared using techniques known to the skilled person, for example using the methods of WO2011/051489 (PCT/EP10/066,572) or by PCR using mutagenic oligonucleotide primers.

Production of shFcRn.

The construction and production of recombinant variants of shFcRn, such as GST-tagged shFcRn, have previously been described (36). Alternatively HIS-tagged shFcRn heterodimer was prepared as described in WO2011/124718.

ELISA.

ELISA, using microtiter plates coated with HSA variants. GST-tagged shFcRn and horse radish peroxidase conjugated goat anti GST antibody was carried out according to Andersen et al (2012; Nature Communications 3:610; DOI: 10.1038/ncomms1607).

Surface Plasmon Resonance.

A Biacore 3000 instrument (GE Healthcare) was used with CM5 sensor chips coupled with shFcRn-GST (~1000-2000 RU) using amine coupling chemistry as described by the manufacturer. The coupling was performed by injecting 10-12 μg/ml of each protein into 10 mM sodium acetate, pH 4.5 (GE Healthcare). For all experiments, phosphate buffer (67 mM phosphate buffer, 0.15 M NaCl, 0.005% Tween 20) at pH 6.0 or 7.4, or HBS-P buffer (0.01 M HEPES, 0.15 M NaCl, 0.005% surfactant P20) at pH 7.4 were used as running buffer and dilution buffer. Kinetic measurements were performed by injecting serial dilutions of HSA variants (80-0.1 μM) at 25°

C. at a flow rate of 50 μl/min. In all experiments, data were zero adjusted, and the reference cell value was subtracted. Kinetic rate values were calculated using predefined models (Langmuir 1:1 ligand model and steady-state affinity model) provided by using the BIAevaluation 4.1 software.

Competitive binding was measured by injecting shFcRn (100 nM) alone or together with titrated amounts of HSA variants (1000-0.015 nM) over immobilized HSA (~2000-2500 RU). The percentage (%) binding of shFcRn to HSA immobilised on the chip was calculated by dividing the total SPR response given by injecting the shFcRn alone by the response when pre-incubated with HSA variant.

Circular Dichroism Spectroscopy

Circular dichroism (CD) spectra were recorded using a Jasco J-810 spectropolarimeter (Jasco International Co., Ltd., Tokyo Japan) calibrated with ammonium d-camphor-10-sulfonate (Icatayama Chemicals, Tokyo Japan). All measurements were performed with a HSA concentration of 2 mg $ml^{-1}$ in 10 mM PBS (pH 6.0) without NaCl added, at 23° C. using a quartz cuvette (Starna, Essex, UK) with a path length of 0.1 cm. Each sample was scanned 7 times at 20 nm $min^{-1}$ (band width of 1 nm) at a response time of 1 s, and the wavelength range was set to 190-260 nm. The collected data were averaged and the spectrum of a sample-free control was subtracted. The content of secondary structural elements was calculated after smoothing (means-movement, convolution width 5) from ellipticity data, using the neural network program CDNN version 2.1 and the supplied neural network based on the 33-member basis set (Bohm et al (1992) *Protein Eng* 5, 191-195).

Docking Procedure.

Docking models of HSA and shFcRn were generated using the ZDOCK Fast Fourier Transform based protein docking program (37). The coordinates for HSA DIII (residues 382-582) were retrieved from the crystal structure of HSA at 2.5 Å (PDB code 1bm0) (19)). Two different models of shFcRn were used: the 2.7 Å resolution structure of FcRn at pH 8.2 (PDB code 1exu) and the 2.6 Å resolution structure at pH 4.2 (PDB code 3m17) 98, 23). The β2m domain, present in both structural models of shFcRn, was included in the receptor model during docking. The ZDOCK program was run with preferences for docking poses with the two histidines His-161 and His-166 in FcRn and residues His-464, His-510 and His-535 in HSA. All crystal structure figures were designed using PyMOL (DeLano Scientific) with the crystallographic data described herein.

Example 1

Construction of Docking Model

Docking models of HSA and shFcRn were generated using the ZDOCK Fast Fourier Transform based protein docking program (Chen R et al (2003) *Proteins* 52 (1):80-87). The coordinates for HSA DIII (residues 382-582) were retrieved from the crystal structure of HSA at 2.5 Å (PDB code 1bm0 (Sugio S et al (1999) *Protein Eng* 12 (6):439-446). Two different models of shFcRn were used: the 2.7 Å resolution structure of FcRn at pH 8.2 (PDB code 1exu) and the 2.6 Å resolution structure at pH 4.2 (PDB code 3m17) (West et al (2000) *Biochemistry* 39 (32):9698-9708, and Mezo A R et al (2010) J Biol Chem 285 (36):27694-27701). The β2m domain, present in both structural models of shFcRn, was included in the receptor model during docking. The ZDOCK program was run with preferences for docking poses with the two histidines His-161 and His-166 in FcRn and residues His-464, His-510 and His-535 in HSA in the protein-protein interface (19). All crystal structure figures were designed using PyMOL (DeLano Scientific) with the crystallographic data described above.

Figure 7:
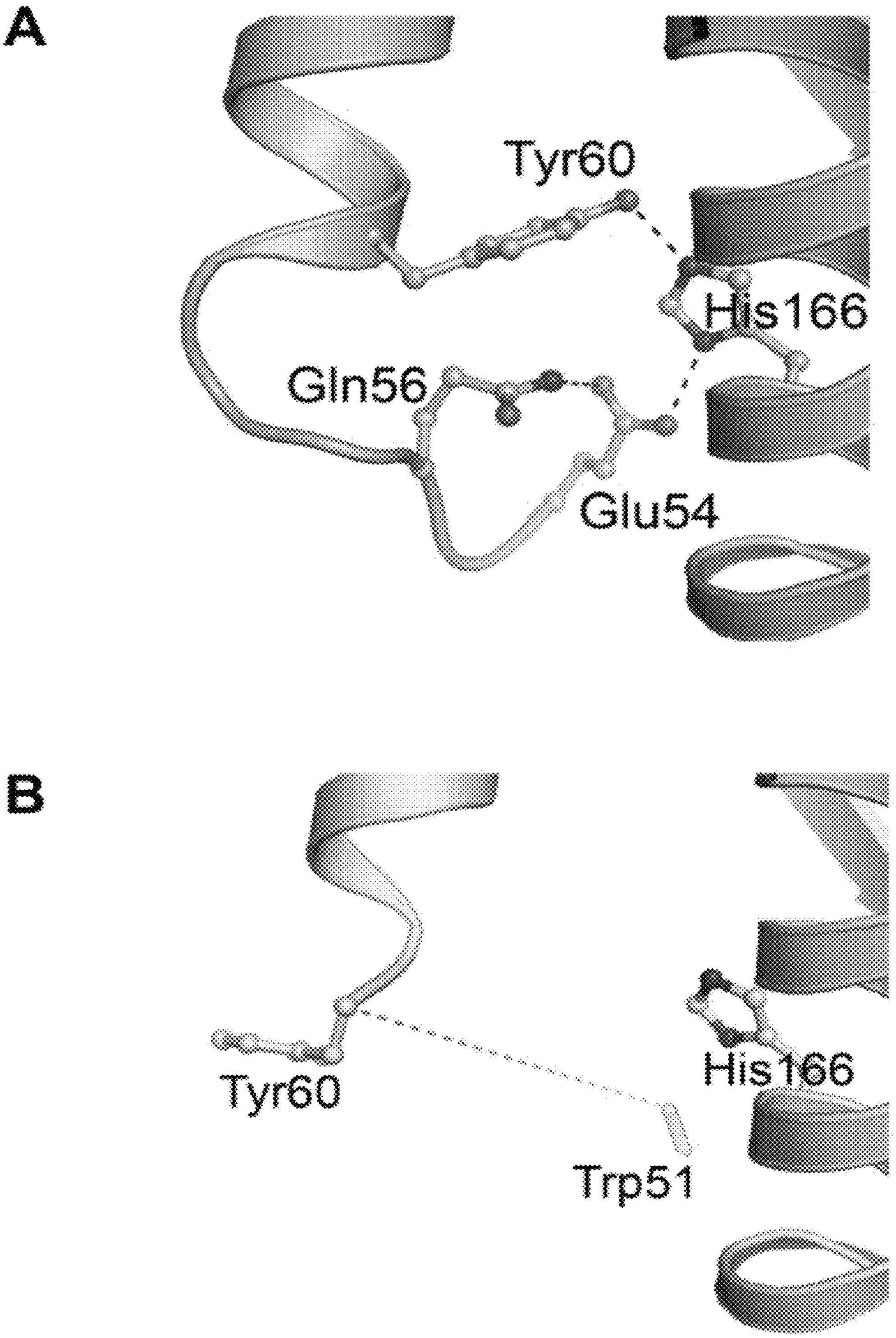
FIG. 7: His-166 stabilizes a flexible loop in a pH-dependent manner. Close up view of the FcRn HC loop area at different pH conditions. (A) At low pH (4.2), the positively charged His-166 forms charge-stabilized hydrogen bond interactions with Glu-54 and Tyr-60 within the surface exposed loop in shFcRn (23). (B) At high pH (8.2), the uncharged His-166 loosens the interactions with Glu-54 and Tyr-60, and the loop between residues Trp-51 and Tyr-60 becomes flexible and structurally disordered (represented by the dashed line) (8). (C) Binding of shFcRn WT and mutants (E54Q, Q56A and H166A) to titrated amount of HSA coated in ELISA wells at pH 6.0.
Figure 7:
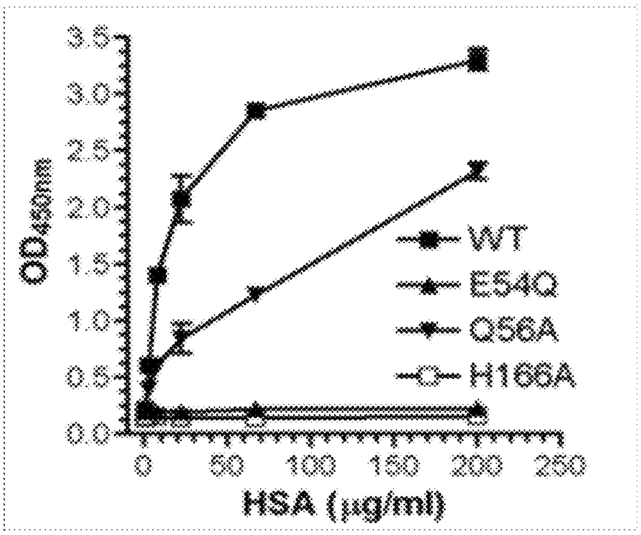
Figure 8:
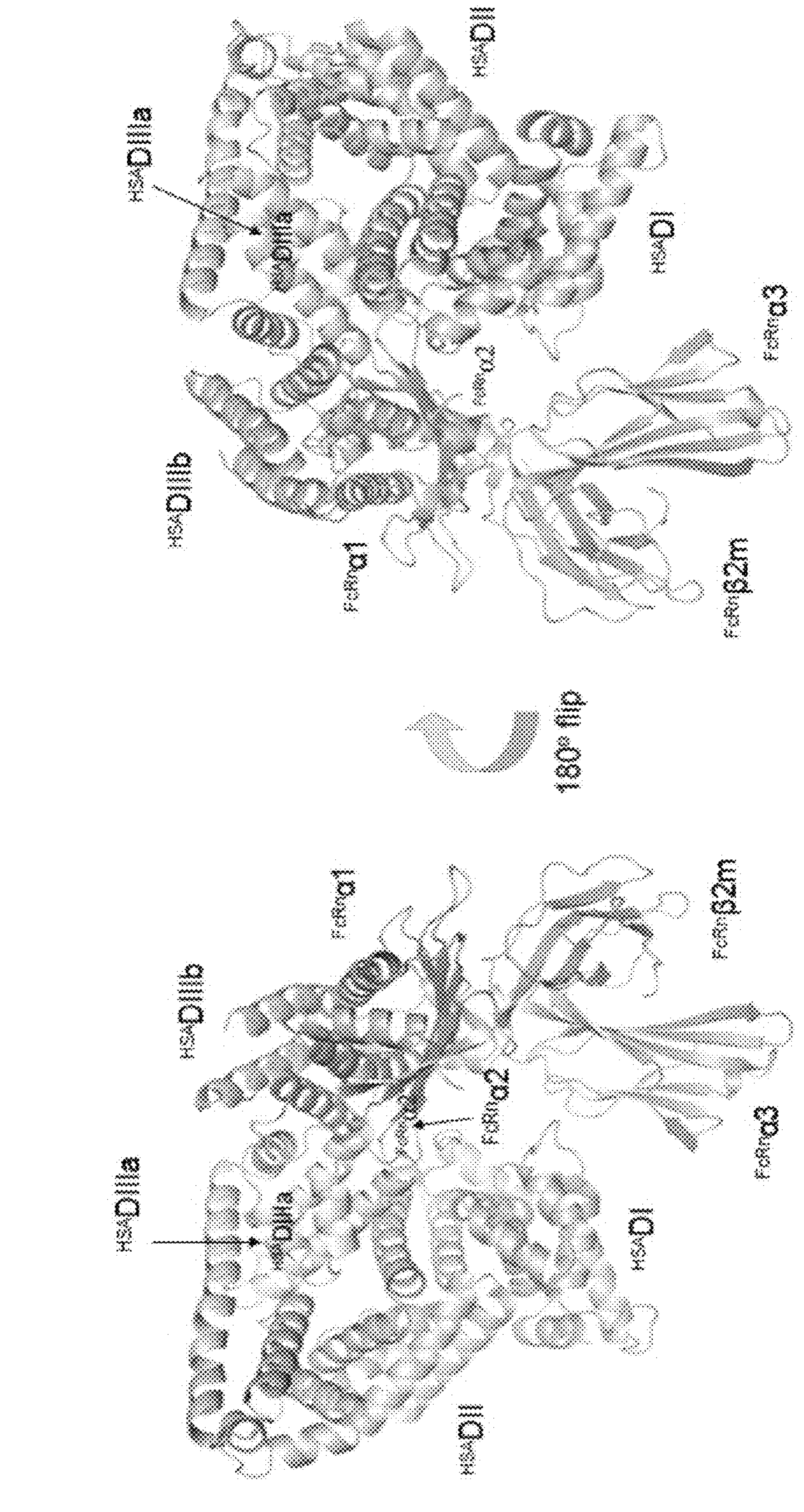
FIG. 8: A proposed shFcRn-HSA docking model.
Figure 8:
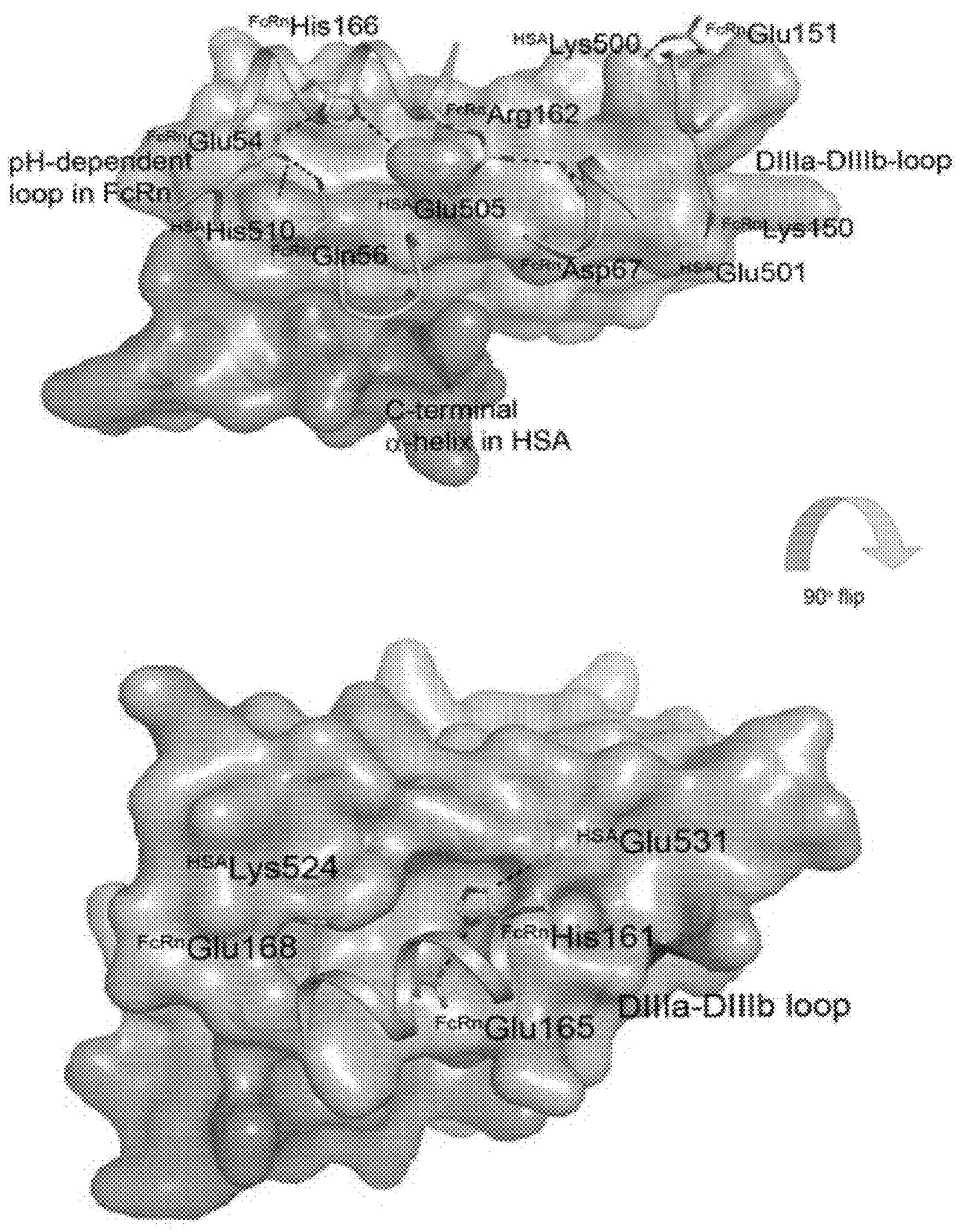
Figure 8:
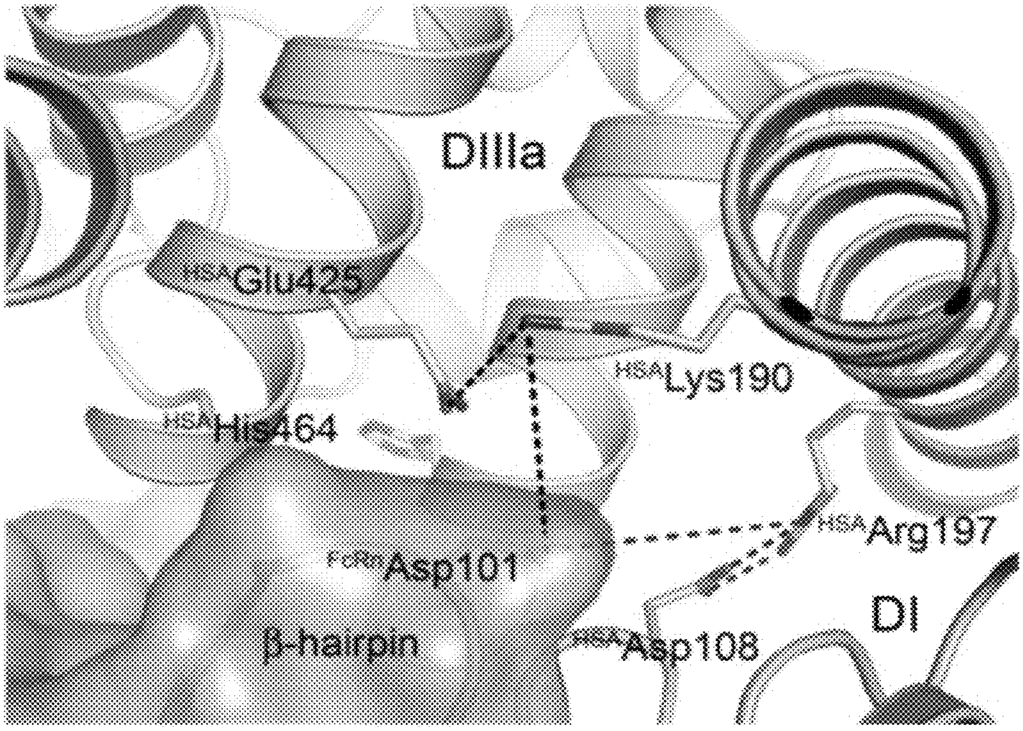

The software returned one model for the docking of sub-domain DIII against shFcRn with an ordered loop at pH 4.2 and eight models for shFcRn at pH 8.2, lacking loop residues 52-59. Among these eight models, five evidently showed erroneous (incompatible) poses as judged by the position of HSA domains DI and DII, and were rejected. The three remaining models were closely related and had the same general structural pose. Superposition of the low pH form of FcRn on these then showed that the structured loop made no severe conflicts with the docked HSA. The final selected model (coordinates are shown in FIGS. 18 and 19) reveals interaction areas that fit very well with the obtained binding data (FIG. 8A). Particularly, the long loop between sub-domains DIIIa and DIIIb (490-510) as well as the C-terminal part (last C-terminal α-helix) of HSA form a crevice on the surface of HSA into which the pH-dependent and flexible loop in shFcRn (residues 51-60) may bind (FIG. 8B). The structure of shFcRn reveals that His-166 stabilizes the loop through intra-molecular interaction with Glu-54 (FIG. 7A), however the docking model suggests that His-166 may additionally be engaged in binding to Glu-505 of HSA (FIG. 88). Glu-505 may also interact with Arg-162 of the receptor. A key role of His-510 is supported by the fact that it is predicted to interact with Glu-54 within the pH-dependent α1-domain loop (FIG. 88). Mutation of His-510 (H510Q) reduced binding by 14-fold (FIG. 3*c*, Table 1). Thus, His-166 in hFcRn and His-510 in HSA seem to be involved in regulating an ionic network in the core of the hFcRn-HSA interaction interface.

The model also predicts possible salt-bridges between Lys-150 and Glu-151 of shFcRn with Glu-501 and Lys-500 of HSA, respectively (FIG. 88). This is in line with the binding data that show reduced binding capacity of HSA variants mutated at these positions (FIG. 68). Furthermore, the model proposes a key role of the alpha helix at the C-terminal end of HSA. This is supported by the fact that deletion of the last 17 amino acids of DIIIb almost eliminated binding to shFcRn (FIG. 14).

Another cleft on the surface of HSA is formed between the DIIIa-DIIIb connecting loop and one of the other α-helices of DIIIb (residues 520-535). Here, His-161 of shFcRn may interact with Glu-531 at acidic pH (FIG. 88). This is in agreement with previous findings where a 10-fold reduced binding affinity was found when His-161 was mutated (Andersen J T et al (2006) The conserved histidine 166 residue of the human neonatal Fc receptor heavy chain is critical for the pH-dependent binding to albumin. Eur J Immunol 36 (11):3044-3051). The HSA-shFcRn complex could further be reinforced by a salt-bridge formed between Glu-168 of shFcRn and Lys-524 of DIII, a prediction that is supported by the fact that mutation of Glu-168 moderately reduces binding to HSA (FIG. 15).

Moreover, His-535 may interact favorably with Phe-157 while His-464 is localized close to a β-hairpin within FcRn encompassing residues 99-102 that is wedged in-between domains DI and the sub-domain DIIIa in HSA (FIG. 8C). Here, shFcRn Asp-101 has several possible partners in DI such as Arg-197 and Lys-190, however, they must necessarily undergo some conformational changes in order to get close to Asp-101. Interestingly, the β-hairpin has two different conformations, depending on the pH (West et al (2000)). This suggests that Asp-101 is indeed located in a flexible element of shFcRn. Crystal structure and immunoglobulin G binding properties of the human major histocompatibility complex-related Fc receptor, Biochemistry 39 (32):9698-9708, and Mezo A R et al (2010) X-ray crystal structures of monomeric and dimeric peptide inhibitors in complex with the human neonatal Fc receptor, FcRn. J Biol Chem 285 (36):27694-27701, suggesting that it forms a flexible element in shFcRn.

The MHC class I-related FcRn has evolved to protect IgG and albumin from catabolism (5, 8, 22). While FcRn binding to IgG has been studied in great detail for decades, its recently discovered interaction with albumin is poorly understood at the molecular level. The data herein provides mechanistic evidence for the importance of several interaction surfaces on both molecules that reveal how they interact in a pH-sensitive fashion, facilitating cellular recycling.

The finding that DIII alone, unlike DI+DII, could bind to the receptor, modulated by pH, conclusively shows that DIII harbors the principal core binding site for FcRn, in agreement with a previous report (9. However, the data also show a role for DI in binding, e.g. the docking model suggests an interaction between FcRn and HSA DI. More specifically, the affinity for DIII alone is considerably weaker than that for full length HSA, a finding that suggest that there may be a moderate contribution to binding to the receptor from DI or DII, either directly or indirectly. The data also show that a DI-DIII construct bound hFcRn slightly stronger than a single HSA DIII. This might be due to structural stabilization of DIII or that DI interacts with hFcRn when fused to DIII, although DI in the DI-DIII fusion has a different location than DI in the full-length HSA. Interestingly, the model suggests that there may be some interactions between DI and shFcRn Several HSA polymorphisms, localized to DIII (16), may affect receptor binding and consequently their levels in blood. One such polymorphism, Casebrook, with a single point mutation that introduces an N-linked glycosylation site, is present in about 35% of WT albumin in heterozygous carriers (20). Introduction of the mutation in rabbit albumin resulted in a variant with 50% reduction in half-life when injected into rabbits (24). Based on these observations, a HSA variant mimicking Casebrook was prepared (WO2011/051489 (PCT/EP10/066,572), incorporated herein by reference) and was found that it had a 2-fold reduction in affinity for shFcRn. This was also the case for Casebrook variant isolated from a heterozygous individual, displaying a 50% decrease in the ability to compete for binding to shFcRn in the presence of WT albumin. When inspecting the crystal structure of shFcRn solved at acidic pH, the partially exposed and protonated His-166 was found to be engaged in stabilizing a loop that was disordered at basic pH, through binding to an acidic (Glu-54) and a polar (Tyr-60) amino acid, respectively. The disorder of the loop is likely explained by loss of protonation of His-166 at basic pH, which then probably regulates the flexibility and conformation of the loop in a pH-dependent manner.

A total of four histidine residues in HSA DIII were individually mutated to glutamine residues. The three highly conserved histidine residues (His-464, His-510 and His-535) were found to be important for binding at acidic pH. The information relating to the importance of the histidine residues present in DIII, and also the importance of His-166 within FcRn for binding to HSA, were used to guide docking of the HSA-shFcRn complex. In line with the molecular data, DIII forms the major interaction interface with a minor contribution from DI. Furthermore, it has been shown that both IgG and albumin bind to non-overlapping sites without interfering with the binding of the other protein (9, 21). This fits well with the docking model where no hindrance exists for simultaneous binding of the two ligands (FIG. 16). Whether or not albumin binding induces conformation changes on the receptor or vice versa cannot be excluded.

Following inspection of the docking model, no direct contact between the oligosaccharide attachment site (Asn-494) present in HSA Casebrook variant and shFcRn was found. However, Asp-494 is part of the N-terminal region of the extended loop (490-510) connecting DIIIa and DIIIb, and it is very likely that alteration of the composition at the N-terminal end of the loop induces conformation changes in the loop at large. Structural importance of Asp-494 and Glu-495 residues is supported by the fact that both are highly conserved across species (FIG. 2). Importantly, the docking model suggests that several residues in the C-terminal end of the loop are in direct contact with the α1-α2-platform of the receptor, with predicted key residues being His-510 and Glu-505 on HSA, as well as Glu-54 on shFcRn. His-510 is one of the three conserved histidine residues, and mutation of this residue (i.e. H510Q) reduced binding to shFcRn significantly. Of the remaining two conserved histidine residues on HSA that are involved in FcRn binding, His-535 may reinforce the HSA-FcRn complex by aromatic stacking or stabilization of the loop between sub-domains DIIIa and DIIIb in HSA. His-464 may interact, directly or indirectly, with a flexible β-hairpin element in FcRn. Interestingly, this β-hairpin loop is the most flexible part in FcRn, except for the pH-dependent loop stabilized by His-166, as judged by a comparison of the low and high pH crystal structures. The flexible β hairpin loop is the most flexible part in FcRn, except for the pH-dependent loop stabilized by His-166, as judged by a comparison of the low and high pH crystal structures. The flexible β-hairpin in shFcRn is in contact with both the α-helix in HSA that contains His-464 as well as a long loop in DI, suggesting an indirect conformational "tuning" of the shFcRn-HSA interface involving DI and DIIIa. In summary, the data shows that histidine residues on both FcRn and albumin are fundamental for optimal pH-dependent binding. The data support a study showing that mutation of conserved histidine residues to alanine resulted in increased clearance of HSA DIII mutants fused to antibody fragments when injected into mice, however, no correlation to FcRn binding was shown (25). Furthermore, from an evolutionary perspective it is interesting that two completely unrelated soluble molecules with different functions have evolved to bind a single cell bound receptor in a similar pH- and histidine-dependent manner that in both cases results in rescue from degradation and prolonged half-life.

The principal function of albumin is to transport fatty acids that are bound asymmetrically to hydrophobic pockets within or between the three domains (1, 26, 27). HSA DIII harbors two high affinity binding sites, and the fatty acids bind close to the loop between HSA DIIIa and DIIIb, which also includes several residues found to affect FcRn binding. Comparison of the fatty acid bound and the free state of HSA (19, 27) shows no substantial rearrangements within sub-domain DIII of HSA upon binding, but a considerable shift in orientation of HSA DI relative to HSA DIII (FIG. 17). In effect, superposition of DIII in the fatty acid binding HSA onto the corresponding FcRn-binding domain in the docking model reveals that DI may move away from FcRn when binding fatty acids.

The half-life regulatory function of FcRn may be utilized for therapeutic and diagnostic purposes, as discussed elsewhere (28, 29). Obviously, bioactive peptides and small proteins obtained from combinatorial libraries or molecular engineering are promising candidates, however, they (and all drugs) may fail to show convincing effects in vivo due to very short half-lives as a consequence of their size being below the renal clearance threshold as well as susceptibility to degradation by proteases (30, 31). This limits transition of such molecules from lead candidate to a drug(s) on the market. A solution to these obstacles may be to take advantage of the prolonged half-life of IgG or albumin controlled by FcRn. Several examples have shown that genetic fusion of therapeutic proteins to the IgG Fc or HSA improves bio-distribution and pharmacokinetics (29).

The serum half-life of IgG may also be extensively improved beyond that evolved by nature. This is an intense area of research that has generated engineered IgG variants with point mutations in their Fc portion resulted in improved pH-dependent FcRn binding, and consequently extended half-life in vivo (4, 5, 32). No examples have so far been presented for albumin, except for the observation that mouse albumin binds much stronger to shFcRn than HSA (21). The docking model presented in this study may guide the development of novel HSA variants with increased serum half-life, which could be attractive for delivery of both chemical and biological drugs.

Tumors and inflamed tissues show increased accumulation of albumin as a result of leaky capillaries and defective lymphatic drainage (33). Consequently, albumin-based therapeutics or diagnostics accumulate at the site of tumor or inflammation. Furthermore, fine-tuning of albumin half-life may also be an attractive approach in relation to tumor targeting and imaging due to tissue toxicity of the fused molecules. Modulation of IgG half-life by attenuating the affinity for FcRn has been shown to improve tumor to normal tissue ratio and consequently improve tumor imaging (34, 35). The HSA variants described in this paper, with substantially reduced or no or intermediate FcRn binding affinities, may serve as attractive albumin candidates.

WO2011/051489 (PCT/EP10/066,572; incorporated herein by reference) shows that a given position of albumin (e.g. position 573 of HSA) can be substituted by any other amino acid to alter the binding affinity for FcRn. Thus, alteration of a signal position provides a group of albumin variants having binding affinity different to the binding affinity of the parent albumin (WT HSA, SEQ ID NO: 2). For position 573, all variants showed improved binding to shFcRn compared with WT HSA. In particular the variants K573F, K573H, K573P, K573W and K573Y had a more than 10 fold lower KD to shFcRn than the parent HSA. The variant K573STOP is a truncated albumin having a stop codon in position 573 and has significantly reduced binding compare to WT HSA.

Example 2

Identification of the Regions of HSA that are Required for Optimal Binding to FcRn and Therefore Whose Alteration Will Alter Binding Affinity Between FcRn and Albumin Based on the docking model, the positions of amino acid residues were identified, visually, which are directly localized at the interaction interface between albumin and FcRn or localized in close proximity to the interface. These positions are shown by dark shading in FIG. 9 and correspond to positions in Domain I of albumin: 30 to 41, 75 to 91, 104 to 120, 144 to 150 and 186 to 201 and to positions in Domain III of albumin: 414 to 426, 457 to 572, 492 to 538 and 550 to 585.

Example 3

Identification of Amino Acid Positions Involved in Binding of HSA to FcRn. DIII is Involved in pH Dependent Binding to FcRn Albumin consists of three homologous domains (DI, DII and DIII), comprising α-helices stabilized by a complex network of twelve cysteine residues forming six disulfide bridges (19). The three domains are linked by loops and form a heart shaped structure (FIG. 48). Two previous studies have pointed to DIII of albumin as being important for FcRn binding (2,17). To confirm this and further investigate how each individual domain contributes to the FcRn binding site, several domain variants (DI-DIII, DII-DIII, DI-DII, DIII) as well as full length HSA (FIG. 4C) were produced in yeast (FIG. 4D). The binding of each to immobilized soluble recombinant human FcRn (shFcRn-GST) was measured by surface plasmon resonance (SPR), such that equal amounts of domain variants were injected at pH 6.0 and pH 7.4. The variant consisting solely of DIII bound shFcRn, and the variant missing DIII did not bind (FIG. 4E). Furthermore, the DI-DIII variant bound slightly stronger to shFcRn than DIII alone (Table 2a). DII, on the other hand, did not seem to contribute to binding.

Each of the three HSA domains has two sub-domains, a and b. To address the importance of the C-terminal subdomain DIIIb, a HSA variant where this domain was deleted was prepared (HSA DIIIa). Lack of DIIIb completely abolished shFcRn binding (FIG. 4F). The recombinant HSA Bartin variant was included for comparison (17) and supports the observation that DIIIb is important for receptor binding. These results demonstrate that an intact DIII is important for receptor binding.

TABLE 2a

SPR-derived kinetics for binding of HSA variants to shFcRn-GST.

| Albumin variant | SEQ ID No. | Ka ($10^3$/Ms) | Kd ($10^{-3}$/s) | KD (μM)[a] |
|---|---|---|---|---|
| WT | 2 | 5.9 ± 0.1 | 7.0 ± 0.2 | 1.1 |
| DIII | 27 | 2.6 ± 0.0 | 72.0 ± 0.0 | 27.0/17.4[b] |
| DI-DII | 145 | NA[d] | NA | NA |
| DII-DIII | 25 | 1.4 ± 0.2 | 30.0 ± 0.2 | 21.4/22.3[b] |
| DI-DIII | 24 | 3.2 ± 0.1 | 45.2 ± 0.1 | 14.1/15.0[b] |
| Q417A | 146 | 5.0 ± 0.0 | 11.1 ± 0.1 | 2.2 |
| H440Q | 147 | 5.1 ± 0.0 | 7.0 ± 0.1 | 1.3 |

TABLE 2a-continued

SPR-derived kinetics for binding of HSA variants to shFcRn-GST.

| Albumin variant | SEQ ID No. | Ka ($10^3$/Ms) | Kd ($10^{-3}$/s) | KD (μM)[a] |
|---|---|---|---|---|
| H464Q | 148 | ND[c] | ND | 14.1[b] |
| D494N (Casebrook) | 149 | 3.8 ± 0.0 | 8.5 ± 0.0 | 2.2 |
| D494A | 150 | 5.9 ± 0.1 | 21.0 ± 0.0 | 3.6 |
| D494Q | 151 | 5.4 ± 0.2 | 25.5 ± 0.1 | 4.7 |
| E495Q | 152 | 4.2 ± 0.0 | 13.1 ± 0.0 | 3.1 |
| E495A | 153 | 3.8 ± 0.1 | 13.0 ± 0.0 | 3.4 |
| T496A | 154 | 5.4 ± 0.0 | 7.6 ± 0.2 | 1.4 |
| D494N/T496A | 155 | 5.4 ± 0.1 | 8.5 ± 0.2 | 1.5 |
| Casebrook | 149 | 3.6 ± 0.1 | 9.7 ± 0.1 | 2.7 |
| P499A | 157 | 2.6 ± 0.0 | 12.1 ± 0.0 | 4.6 |
| K500A | 158 | 14.3 ± 0.2 | 47.8 ± 0.0 | 33.4 |
| E501A | 159 | 5.1 ± 0.0 | 9.8 ± 0.0 | 1.9 |
| H510Q | 160 | ND | ND | 12.1[b] |
| H535Q | 161 | ND | ND | 16.2[b] |
| K536A | 162 | 4.4 ± 0.2 | 9.3 ± 0.1 | 2.1 |
| P537A | 163 | 3.7 ± 0.1 | 14.3 ± 0.2 | 3.9 |
| K538A | 164 | 3.9 ± 0.0 | 7.1 ± 0.0 | 1.8 |
| HSA 568Stop | 45 | ND | ND | 17.0 |
| HSA DIIIa | 165 | NA | NA | NA |

[a]The kinetic rate constants were obtained using a simple first-order (1:1) Langmuir bimolecular interaction model, which assumes that one HSA molecule binds one FcRn. The kinetic values represent the average of triplicates.
[b]The steady-state affinity constant was obtained using an equilibrium (Req) binding model supplied by the BIAevaluation 4.1 software. The kinetic values represent the average of triplicates.
[c]ND, not determined due to no or very weak binding.
[d]NA, not acquired because of fast binding kinetics.

Casebrook—a Point Mutation in HSA DIII that Alters FcRn Binding

Figure 5:
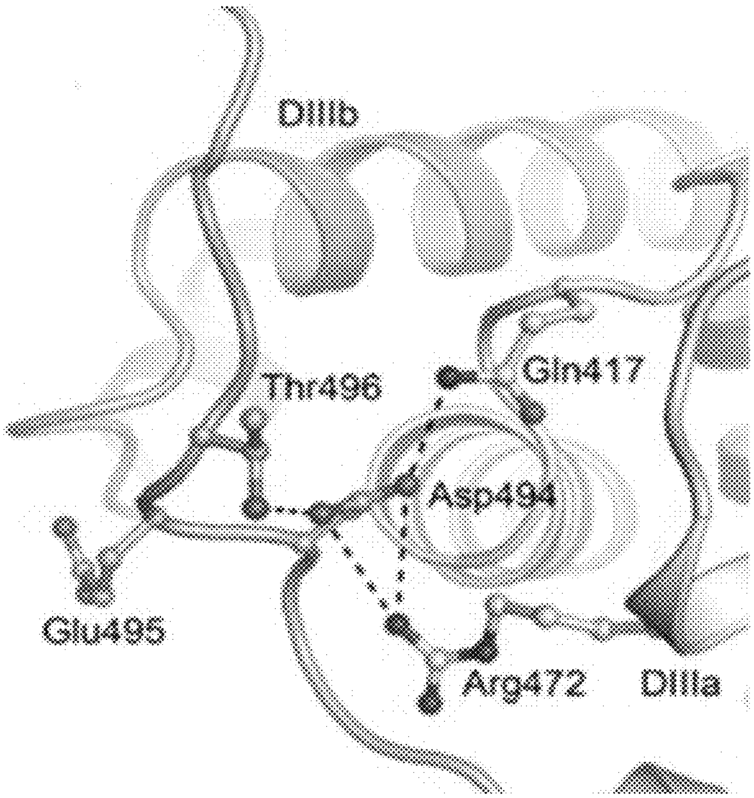
FIG. 5: The structural implications of HSA Casebrook on shFcRn binding. (A) Close-up view of the interaction network around Asp-494 in HSA. Asp-494 is located in the loop connecting sub-domain DIIIa (cyan) and DIIIb (blue). Asp-494 forms an ionic interaction with Arg-472 and a hydrogen bond interaction with Gln417, which both are located in sub-domain DIIIa. Asp-494 also forms a hydrogen bond with Thr-496, thus stabilizing the loop connecting DIIIa and DIIIb. (B) SDS-PAGE gel migration of the mutants D494N, D494A, D494Q, E495Q, E495A, T496A and D494N/T496A. SPR sensorgrams showing binding of shFcRn to WT HSA and (C) recombinantly produced Casebrook (D494N), D494A and D494Q. (D) E495Q and E495A and (E) T496A and D494N/T496A at pH 6.0. (F) SPR sensorgrams of shFcRn binding to WT HSA and Casebrook isolated from a heterozygote patient. (G) Competitive binding of WT HSA and Casebrook to shFcRn at pH 6.0. The receptor was injected in the presence of titrated amounts of WT or Casebrook HSA over immobilized HSA. (H) SPR sensorgrams showing binding of shFcRn to WT HSA and Q417A at pH 6.0.
Figure 5:
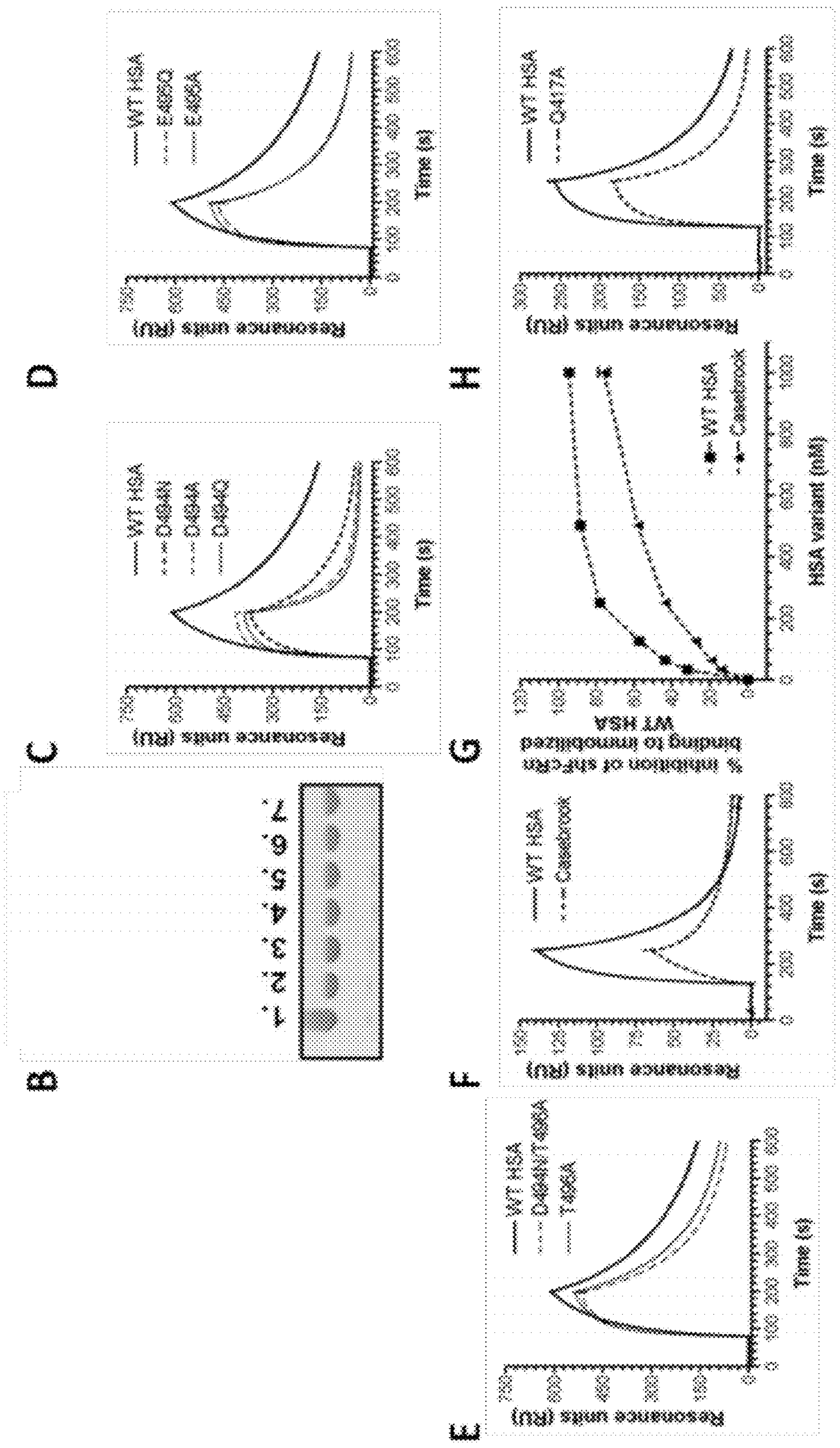
Figure 6:
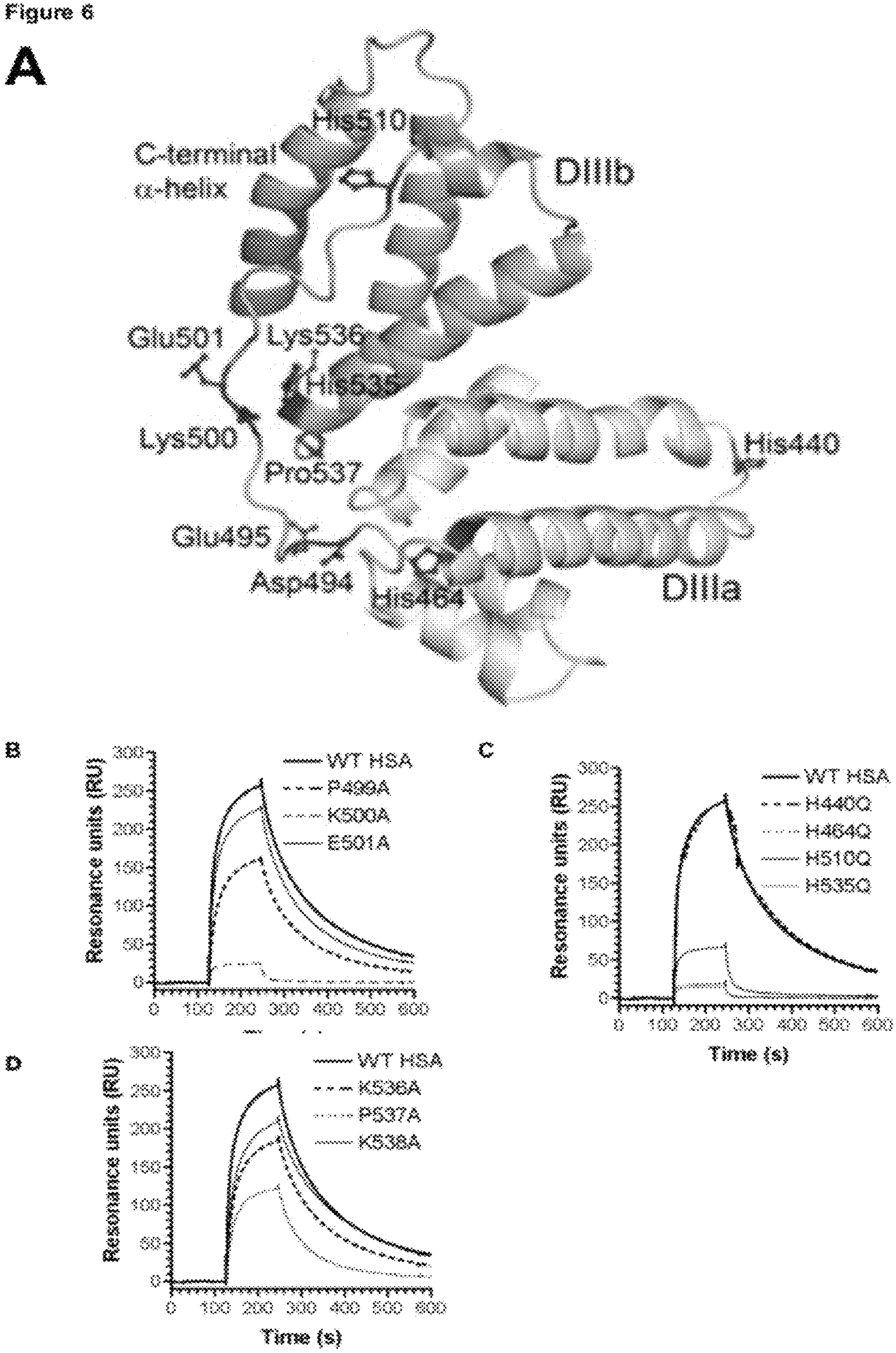
FIG. 6: Conserved histidines are fundamental for binding to shFcRn. (A) Location of selected residues in DIII of HSA. Residues in the loop connecting the sub-domains DIIIa and DIIIb selected for mutagenesis (Asp-494, Glu-495, Lys-500 and Glu-501) as well as additional residues close to the connecting loop such as the conserved histidines (His-464, His-510 and His-536) and Lys-536 and Pro-537 are displayed as ball-and-stick (maroon). The non-conserved His-440 is distally localized. The last C-terminal α-helix is highlighted in yellow (labeled 'C-terminal α-helix'). SPR sensorgrams of shFcRn binding to WT HSA and (B) P499A, K500A and E501A, and (C) H440Q, H464Q, H510Q and H535Q as well as (C) K536A, P537A and K538A at acidic pH (6.0).

HSA is normally non-glycosylated, but a few exceptions exist due to rare polymorphisms (16). One such variant (Casebrook) has a single nucleotide substitution that changes the coding from Asp to Asn at amino acid residue 494 (20), localized in the stretch of amino acids (residue 490-510) that form a long loop connecting the sub-domains DIIIa and DIIIb (FIGS. 5A and 6A). This natural polymorphism introduces a glycosylation motif ($^{494}$Asn-Glu-Thr$^{496}$) and attachment of an N-linked oligosaccharide. A study was made of migration in SDS-PAGE and FcRn binding of a number of recombinant HSA variants that allowed us to dissect the role of the oligosaccharide and individual amino acids at $^{494}$Asn-Glu-Thr$^{496}$. The recombinant version of Casebrook (D494N) migrated more slowly than wild type (WT) HSA in SDS-PAGE, which reflects attachment of oligosaccharide residues (FIG. 58). Moreover, in six variants, D494A, D494Q, E495Q, E495A, T496A and D494N/T496A, the glycosylation motif was disrupted, and consequently, all of these mutants migrated like their WT counterpart (FIG. 58).

All variants were tested for binding to immobilized shFcRn by SPR, and distinct binding differences were detected at acidic pH with a hierarchy from strongest to weakest binding as follows; WT>T496A>D494N/T496A>D494N>E495Q E495A>D494A>D494Q (FIG. 5C-F, Table 2a). The same trend was obtained when binding was studied by ELISA (FIG. 10). The binding kinetics revealed differences in dissociation rates for most mutants except D494N (Casebrook), which showed a 2-fold reduced binding affinity, resulting from both altered association and dissociation constants. Mutation of Asp-494 and Glu-495 to Ala or Gln had a large effect on receptor binding, while mutation of the flanking Thr-496 had only a small effect on binding. The HSA Casebrook variant isolated from a heterozygous individual bound shFcRn similar to its recombinant counterpart (FIG. 5F, FIG. 11, Table 2a).

The Casebrook variant is present at a 2-3 fold lower level than normal HSA in heterozygous individuals (20). To mimic an in vivo situation, where the Casebrook variant exists in the presence of large amounts of WT HSA that competes for FcRn binding, a competitive SPR-based assay was used and found that the ability of the Casebrook variant to compete for receptor binding was reduced by almost 50% compared with HSA WT (FIG. 5G), a finding that mirrors the 2-fold reduction in binding affinity (Table 2a).

Structural Implications of Casebrook—Stability of the DIIIa-DIIIb Connecting Loop The integrity and folding of the HSA mutants were investigated by circular dichroism. No major difference from that WT HSA was observed for any of the mutants at both pH 7.4 and pH 6.0 (FIG. 12, Table 3).

TABLE

3 Secondary structural elements determined by CD

| HSA Variant | Structural elements pH 7.4 Helix | Anti-parallel | Parallel | Beta turn | Random Coli | Structural elements pH 6.0 Helix | Anti-parallel | Parallel | Beta turn | Random Coli |
|---|---|---|---|---|---|---|---|---|---|---|
| WT | 72 | 0 | 0.7 | 7.3 | 20 | 64.8 | 0.5 | 1.7 | 10.1 | 22.4 |
| D494N | 65.6 | 0.4 | 1.7 | 10.3 | 22 | 67.9 | 0.2 | 1.4 | 9.3 | 21.2 |
| D494A | 62.2 | 1.4 | 2.5 | 12.7 | 21.2 | 65.9 | 0.5 | 1.7 | 10.3 | 21.7 |
| E495Q | 65.3 | 0.3 | 1.7 | 10.4 | 22.2 | 65 | 0.6 | 1.8 | 10.5 | 22.1 |
| E495A | 64.8 | 0.5 | 1.8 | 10.6 | 22.2 | 65.1 | 0.5 | 1.7 | 10.5 | 22.2 |
| D494Q | 66.1 | 0.3 | 1.6 | 10.1 | 21.8 | 67.1 | 0.3 | 1.5 | 9.5 | 21.6 |
| D494N + T496A | 64.2 | 1 | 1.9 | 11.2 | 21.7 | 65.2 | 0.4 | 1.8 | 10.3 | 22.3 |
| T496A | 65.8 | 0.5 | 1.6 | 10.2 | 22 | 64.5 | 0.6 | 1.9 | 10.8 | 22.3 |

Next, the crystal structure of HSA (19) was inspected, and found Asp-494 to be involved in an intra-molecular network of polar interactions involving amino acids in both DIII sub-domains, a and b (FIG. 5A). The carboxylic side chain of Asp-494 forms a charged-stabilized salt-bridge with Arg-472 as well as hydrogen bonds with both Gln-417 and Thr-496. N-linked glycosylation of Asn-494 will reduce its hydrogen-bonding capacity and eliminate the negative component of the salt-bridge, which may be important for stabilizing the loop. In support of this is the finding that a Q417A mutation also has reduced binding to shFcRn (FIG. 5H, Table 2a). Furthermore, glycosylation, i.e. an introduction of a bulky moiety, may very well destabilize the N-terminal end of the loop encompassing residues 490-495, and thus affect its conformation.

Beside Asp-494, Glu-495 and Thr-496 at the N-terminal end of the loop, Pro-499, Lys-500 and Glu-501 in the middle of the loop (FIG. 6A) were targeted by mutagenesis and investigated the effect on shFcRn binding. Moderate effects were found for P499A and E501A, while K500A dramatically reduced binding to the receptor (FIG. 68, Table 2a).

A Role for Conserved Histidine Residues in HSA DIII

Guided by the fact that histidine residues are key players in the strictly pH-dependent IgG-FcRn interaction (4, 5), the role of the four histidine residues found within HSA DIII were assessed. Of these, three are highly conserved across species (His-464, His-510 and His-535) and one is not (His-440) (FIG. 2). While His-440 and His-464 are found within sub-domain DIIIa, His-510 is localized to the end of the loop connecting sub-domains DIIIa and DIIIb, and His-535 is found in one of the α-helices of DIIIb (FIG. 6A). All four histidine residues were mutated individually to glutamine (FIG. 13) and tested for binding to shFcRn at pH 6.0. Mutation of each of the three conserved histidine residues almost completely abolished binding, whereas mutation of the non-conserved His-440 did not (FIG. 6C, Table 2a). Thus, the data pin point the three histidine residues within DIII as fundamental for pH-dependent FcRn binding, which parallels the requirement for conserved histidine residues in the Fc elbow region of IgG (His-310 and His-435).

Furthermore, amino acids in the vicinity of His-535 (Lys-536, Pro-537 and Lys-538), when individually mutated to alanine residues, were also shown to attenuate binding (FIG. 6D, Table 2a). Taken together, the binding data define a core structural area on DIII important for pH-dependent FcRn binding.

Mapping the Binding Site on FcRn

We have previously identified a highly conserved histidine residue localized to the α2-domain of both mouse and human FcRn HC to be important for albumin binding (His-168 and His-166, respectively) (21, 22). To obtain a molecular explanation, a crystal structure of shFcRn that was recently solved under acidic conditions (pH 4.2) (FIG. 4A) (23) was inspected. It was found that His-166 is engaged in a network of intra-molecular interactions that involves charge stabilized hydrogen bonds with Glu-54 and Tyr-60 found on a surface exposed loop within the α1-domain (residue 51-60) (FIG. 7A). At low pH, His-166 will carry a positive charge and this suggests that uncharged His-166 will loosen or lose its interactions with Glu-54 and Tyr-60 at physiological pH, which will result in a more flexible loop. This explanation is supported by the fact that this loop-region is structurally disordered in the crystal structure of shFcRn solved at basic pH (pH 8.5) (FIG. 7B). Further, the corresponding loop is also ordered with a defined conformation in the co-crystal structure of rat FcRn in complex with rat IgG2a Fc solved at acidic pH (6). A comparison of the two human FcRn structures at low and high pH suggests a pivotal regulatory role of His-166 in locking and release of the flexible loop between Trp-51 and Tyr-60 (FIGS. 7*a* and 7*b*).

Glu-54 is also involved in an interaction with Gln-56 (FIG. 7A). To address the importance of Glu-54 and Gln-56, both residues were individually mutated to glutamine or alanine, respectively, and the two resulting receptor variants (shFcRn E54Q and shFcRn Q56A) were tested for binding to HSA by ELISA at pH 6.0 (using the method described in WO2011/051489 (PCT/EP10/066,572), incorporated herein by reference). The impact of the E54Q mutation was striking, as almost no receptor binding to HSA was detected, whereas the Q56A variant partially lost binding to HSA (FIG. 7C). Thus, the data demonstrate an important structural role for His-166 in stabilizing the α1-domain loop of shFcRn in a pH-dependent fashion via binding to Glu54, and that an ordered structure of this loop at acidic pH is indispensable for efficient albumin binding.

Example 4

Truncation of the C-Terminal End of HSA Modulates Binding to shFcRn

Expression constructs for truncated HSA mutants (Table 6, below) were generated by PCR and gap-repair. PCR products were generated using Phusion Polymerase (New England Biolabs), according to the manufacturer's instruction, using pDB3927 (described in WO2010/092135 (incorporated herein by reference)) as a template and oligonucleotides (Tables 4 and 5). This resulted in DNAs in which specific codons (i.e. amino acids 568 and 572 to 585, excluding position 573) were replaced with the translational stop codon amino TAA. These PCR products were cloned into plasmids and used to form expression plasmids in yeast by gap repair.

TABLE 4

Truncated HSA molecules

| Molecule | SEQ ID No. (molecule) | Oligonucleotide pair | Plasmid |
|---|---|---|---|
| HSA 585stop | 32 | xAP265/xAP294 | pDB4544 |
| HSA 584stop | 33 | xAP265/xAP295 | pDB4545 |
| HSA 583stop | 34 | xAP265/xAP296 | pDB4546 |
| HSA 582stop | 35 | xAP265/xAP297 | pDB4547 |
| HSA 581stop | 36 | xAP314/xAP298 | pDB4548 |
| HSA 580stop | 37 | xAP314/xAP299 | pDB4549 |
| HSA 579stop | 38 | xAP314/xAP300 | pDB4550 |
| HSA 578stop | 39 | xAP314/xAP301 | pDB4551 |
| HSA 577stop | 40 | xAP314/xAP302 | pDB4552 |
| HSA 576stop | 41 | xAP314/xAP303 | pDB4553 |
| HSA 575stop | 42 | xAP314/xAP304 | pDB4554 |
| HSA 574stop | 43 | xAP314/xAP305 | pDB4555 |
| HSA 572stop | 44 | xAP314/xAP306 | pDB4556 |
| HSA 568stop | 45 | xAP314/xAP307 | pDB4557 |

In Table 4, albumin variants are named such that 'HSA 585stop' is an HSA variant in which the native amino acid at position 585 is substituted with a stop codon.

Specifically, for HSA568stop expression construct oligonucleotides xAP314 and xAP307 were used to amplify a 493 bp fragment from pDB3927, containing DNA sequence encoding HSA DIII, according to the manufacturer's instructions. A stop codon was engineered into oligonucleotide xAP307 so that translation of the DNA sequence encoding HSA terminated following amino acid 567. The PCR fragment was digested with AvrII/Bsu361 purified using a Qiagen PCR-clean up kit (according to the manufacturer's instructions) and ligated into AvrII/Bsu361-digested pDB3927. Ligations were transformed into *E. coli* DH5a, subsequently plasmids were isolated from transformants (Qiagen miniprep kit (according to the manufacturer's instructions)) and the correct constructs were identified by restriction analysis. This produced the HSA568stop expression construct pDB4557.

The HSA572stop and HSA574stop to HSA581 stop expression constructs were made in the same manner as the HSA568stop construct using the oligonucleotides (Table 5) to produce plasmids pDB4548 to pDB4556 (Table 4).

For the HSA582stop to HSA585stop constructs (1.122 kb) fragments were PCR amplified from pDB3927 using oligonucleotides (Table 5). The PCR-fragments were each digested with BglII/HindIII isolated and ligated into pDB2923 (Finnis, C. J. et al. (2010). High-level production of animal-free recombinant transferrin from *Saccharomyces cerevisiae. Microb Cell Fact* 9, 87) to produce plasmids #10D, #11B, #12C and #13D, respectively. Plasmids #10D to #13D were digested with AvrII/SphI and 666 bp fragments (containing the DNA encoding the C-terminal end of albumin) were isolated from each and ligated into AvrII/SphI-digested pDB3927 to produce the gap-repair constructs pDB4544-pDB4547, respectively (Table 4).

Plasmids pDB4544-pDB4557 were digested with NsiI/PvuI, the DNA was purified (Qiagen PCR Purification kit as per the manufacturer's instructions), before being used, along with Acc651/BamHI-digested pDB3936, to co-transform *S. cerevisiae* BXP10cir$^0$ as described above generating expression plasmids in the yeast by gap-repair.

Stocks were prepared for each resultant yeast strain. 10 ml BMMD broth (0.17% (w/v) yeast nitrogen base without amino acid and ammonium sulphate (Difco), 37.8 mM ammonium sulphate, 36 mM citric acid, 126 mM disodium hydrogen orthophosphate pH6.5, 2% (w/v) glucose, adjusted to pH 6.5 with NaOH) was inoculated with the required strain and grown for 48 hours at 30° C. with orbital shaking at 200 rpm. 5 mL of each culture was then mixed with an equal volume of 40% [w/v] trehalose and 1 ml aliquots transferred to cryovials for storage at −80° C.

Construction of a yeast strain producing the HSA573stop variant is described in WO2011/0541489 (incorporated herein by reference).

TABLE 5

Oligonucleotide sequences for preparation of truncated HSA mutants

| Oligo-nucleotide | Sequence (5'-3') | SEQ ID No: |
|---|---|---|
| xAP265 | GCTCGCCTGAGCCAGAG | 46 |
| xAP294 | GAATTAAGCTTATTATTAGCCTAAGGCAGC | 47 |
| xAP295 | GAATTAAGCTTATTATAATTATAAGGCAGC | 48 |
| xAP296 | GAATTAAGCTTATTATAAGCCTTAGGCAGCTTG | 49 |
| xAP297 | GAATTAAGCTTATTATAAGCCTAATTAGGCTTGACTTGC | 50 |
| xAP298 | GAATTAAGCTTATTATAAGCCTAAGGCTTATTGACTTGCAGCAACAAG | 51 |
| xAP299 | GAATTAAGCTTATTATAAGCCTAAGGCAGCTTAACTTGCAGCAACAAG | 52 |
| xAP300 | GAATTAAGCTTATTATAAGCCTAAGGCAGCTTGTTATGCAGCAACAAG | 53 |
| xAP301 | GAATTAAGCTTATTATAAGCCTAAGGCAGCTTGACTTTAAGCAACAAG | 54 |
| xAP302 | GAATTAAGCTTATTATAAGCCTAAGGCAGCTTGACTTGCTTAAACAAGTT TTTTAC | 55 |

TABLE 5-continued

Oligonucleotide sequences for preparation of truncated HSA mutants

| Oligo-nucleotide | Sequence (5'-3') | SEQ ID No: |
|---|---|---|
| xAP303 | GAATTAAGCTTATTATAAGCCTAAGGCAGCTTGACTTGCAGCTTAAAGTT TTTTAC | 56 |
| xAP304 | GAATTAAGCTTATTATAAGCCTAAGGCAGCTTGACTTGCAGCAACTTATT TTTTACCCTC | 57 |
| xAP305 | GAATTAAGCTTATTATAAGCCTAAGGCAGCTTGACTTGCAGCAACAAGTT ATTTACCCTC | 58 |
| xAP306 | GAATTAAGCTTATTATAAGCCTAAGGCAGCTTGACTTGCAGCAACAAGTT TTTTTTACTCCTC | 59 |
| xAP307 | GAATTAAGCTTATTATAAGCCTAAGGCAGCTTGACTTGCAGCAACAAGTT TTTTACCCTCCTCGGCTTAGCAGG | 60 |
| xAP314 | CTCAAGAAACCTAGGAAAAGTGGGCAGC | 61 |

The following variants (fragments) were generated and binding to the shFcRn-GST was determined as described in Materials and Methods. More specifically, codons encoding amino acids at the C-terminal end of HSA were individually replaced with TAA (i.e. a translation stop codon) to generate the truncated HSA variants of Table 6. Binding data for the HSA variants binding to shFcRn are presented in Table 6, FIG. 20 and FIG. 21.

TABLE 6

SPR-derived kinetics for binding of HSA truncation variants to shFcRn-GST.

| Albumin variant[a] | Ka ($10^3$/Ms) | kd ($10^{-3}$/s) | KD[b] (μM) | KD[c] (μM) |
|---|---|---|---|---|
| WT | 6.6 ± 0.1 | 9.1 ± 0.1 | 1.3 | 2.4 |
| 584Stop | 8.6 ± 0.0 | 32.0 ± 0.1 | 3.7 | ND |
| 582Stop | 13.0 ± 0.2 | 65.0 ± 0.0 | 5.0 | ND |
| 581Stop | 3.6 ± 0.0 | 32.0 ± 0.1 | 9.0 | ND |
| 580Stop | 9.8 ± 0.1 | 6.0 ± 0.0 | 6.1 | 13.2 |
| 579Stop | ND | ND | ND | 17.0 |
| 578Stop | ND | ND | ND | 19.9 |
| 577Stop | ND | ND | ND | 23.0 |
| 573Stop | ND | ND | ND | 14.1 |
| 572Stop | ND | ND | ND | 10.4 |
| 568Stop | ND | ND | ND | 23.0 |

[a]Dilutions of HSA variants were injected over immobilized shFcRn (~2000 RU).
[b]The kinetic rate constants were obtained using a simple first-order (1:1) bimolecular interaction model. The kinetic values represent the average of duplicates.
[c]The steady state affinity constant was obtained using an equilibrium (Req) binding model supplied by the BIAevaluation 4.1 software.
[d]Not determined (ND).

The data of Table 6 and FIG. 20 show the importance of the C-terminus of HSA in pH dependent binding to shFcRn. Surprisingly, removal of the last amino acid (Leu585) reduced binding to the receptor by 50% compared to WT HSA and further truncation increased the effect (FIG. 20).

Similarly, the general trend in reduced affinity with an increase in truncation length is observed in a competitive binding assay (FIG. 21). i.e. competition was progressively reduced with removal of more amino acids.

Determination of KDs shows the dramatic impact of C-terminal truncations (Table 4).

Example 5

Alterations in the C-Terminal End of HSA Modulates Binding to shFcRn

Expression constructs of HSA mutants (Table 7, below) were generated by PCR and gap-repair. This was achieved by generating PCR products using Phusion Polymerase (New England Biolabs), according to the manufacturer's instruction, using pDB3927 as a template and oligonucleotides (Table 7 and 8). Each PCR-fragment was digested with AvrII/Bsu361, purified (Qiagen PCR-clean up kit (according to the manufacturer's instructions)) and ligated into AvrII/Bsu361-digested pDB3927. Ligations were transformed into *E. coli* DH5a, subsequently plasmids were isolated from transformants (Qiagen miniprep kit (according to the manufacturer's instructions)) and the correct constructs were identified by sequencing.

TABLE 7

Alterations in the C-terminal end of HSA

| Molecule | SEQ ID No. (molecule) | Oligonucleotide pair | Plasmid |
|---|---|---|---|
| HSA K574A | 62 | xAP314/xAP309 | pDB4536 |
| HSA Q580A | 63 | xAP314/xAP308 | pDB4535 |
| HSA K573P/Q580A | 64 | xAP314/xAP311 | pDB4537 |

TABLE 8

Oligonucleotide sequences for preparation alterations in the C-terminal end of HSA

| Oligonucleotide | Sequence (5'-3') | SEQ ID No: |
|---|---|---|
| xAP308 | GAATTAAGCTTATTATAAGCCTAAGGCAGCAGCACTTGCAGCA ACAAG | 65 |

TABLE 8-continued

| Oligonucleotide sequences for preparation alterations in the C-terminal end of HSA | | |
|---|---|---|
| OligonucleotideSequence (5'-3') | | SEQ ID No: |
| xAP309 | GAATTAAGCTTATTATAAGCCTAAGGCAGCTTGACTTGCAGCA ACAAGAGCTTTACCCTC | 66 |
| xAP311 | GAATTAAGCTTATTATAAGCCTAAGGCAGCAGCACTTGCAGCA ACAAGTTTTGGACCCTCC | 67 |
| xAP314 | CTCAAGAAACCTAGGAAAAGTGGGCAGC | 61 |

Plasmids, pDB4535 to pDB4537, containing the desired substitutions (Table 7) were digested with NsiI/PvuI, the DNA was purified (Qiagen PCR Purification kit as per the manufacturer's instructions), before being used, along with Acc651/BamHI-digested pDB3936, to co-transform *S. cerevisiae* BXP10cir$^0$ as described above generating expression plasmids in the yeast by gap-repair. Stocks were prepared for each resultant yeast strain as described above.

The following variants were generated and binding affinity to the shFcRn-GST was determined as described in Materials and Methods. The results are presented in Table 9 and FIG. 22.

TABLE 9

SPR-derived kinetics for binding of HSA variants to shFcRn-GST.

| Albumin variant[a] | Ka ($10^3$/Ms) | kd ($10^{-3}$/s) | KD[b] (μM) | KD[c] (μM) |
|---|---|---|---|---|
| WT | 6.6 ± 0.1 | 9.1 ± 0.1 | 1.3 | 2.4 |
| K574A | 5.2 ± 0.1 | 9.9 ± 0.0 | 1.9 | ND[d] |
| Q580A | 3.5 ± 02 | 18.0 ± 0.1 | 5.1 | ND |
| K573P/Q580A | 4.1 ± 0.1 | 2.0 ± 0.0 | 0.4 | ND |

[a]Dilutions of HSA variants were injected over immobilized shFcRn (~2000 RU).
[b]The kinetic rate constants were obtained using a simple first-order (1:1) bimolecular interaction model. The kinetic values represent the average of duplicates.
[c]The steady state affinity constant was obtained using an equilibrium (Req) binding model supplied by the BIAevaluation 4.1 software.
[d]Not determined (ND).

The data provide further evidence of the importance of the C-terminal end of HSA in pH dependent binding to shFcRn. Alanine substitutions of Q580 and K574 were shown to reduce the binding affinity by approximately 2 and 4 fold, respectively (FIG. 22 and Table 5). A double mutant (combining K573P with Q580A) gave rise to improved affinity for shFcRn. Taken together, the data of Examples 4 and 5 show the importance of amino acids in the last α-helix of DIIIb for binding of albumin to shFcRn.

Example 6

SPR Analysis of Binding Affinity of Albumin Variants to shFcRn

Variants of albumin were generated according to the methods below.

Preparation of Specific HSA Mutein Expression Plasmids.

HSA variants were expressed using several standard molecular biology techniques, such as described in Sambrook, J. and D. W. Russell, 2001 (Molecular Cloning: a laboratory manual, 3$^{rd}$ ed. Cold Spring Harbor Laboratory Press, Cold Spring Harbor, N.Y.). Described below are two methods employed to introduce mutations within the HSA sequence, depending on the proximity of suitable restriction sites in the plasmid encoding WT HSA, pDB3964 (described in WO2010/092135, incorporated herein by reference).

Method 1:

Where restriction sites proximal to the desired mutation existed, mutagenic oligonucleotides were designed, incorporating both the desired change and relevant restriction sites (Tables 10 and 11). The relevant primers were employed in the PCR reaction (described in Tables 12 and 13), utilising the New England Biolabs Phusion kit and pDB3964 as template. The resulting products were purified (QIAquick PCR Purification Kit, according to the manufacturer's instructions). The products were digested with appropriate restriction enzymes (Table 10) and purified (QIAquick Gel Extraction Kit (according to the manufacturer's instructions)). The resulting fragments were ligated into appropriately digested pDB3964 such that the WT HSA sequence was substituted with the HSA sequence containing the desired mutation. Ligations were transformed into *E. coli* DH5α cells and plasmids were isolated (Qiagen Plasmid Plus Kit (according to the manufacturer's instructions)). All plasmids were sequenced to confirm that the HSA sequence was only mutated at the desired position(s).

TABLE 10

Plasmid and amino acid substitution and relevant primers (see also Table 2)

| Mutant | SEQ ID No. (mutant) | Oligo 1 | Oligo 2 | Restriction enzyme digest plan | Digested fragment size (kb) | Plasmid name |
|---|---|---|---|---|---|---|
| HSA N503D | 69 | xAP452 | xAP453 | SalI/Bsu36I | 0.269 | pDB4703 |
| HSA E505Q | 70 | xAP453 | xAP491 | SalI/Bsu36I | 0.269 | pDB4704 |
| HSA H510D | 71 | xAP455 | xAP453 | SalI/Bsu36I | 0.269 | pDB4705 |
| HSA H510E | 72 | xAP456 | xAP453 | SalI/Bsu36I | 0.269 | pDB4706 |

TABLE 10-continued

Plasmid and amino acid substitution and relevant primers (see also Table 2)

| Mutant | SEQ ID No. (mutant) | Oligo 1 | Oligo 2 | Restriction enzyme digest plan | Digested fragment size (kb) | Plasmid name |
|---|---|---|---|---|---|---|
| HSA D512E | 73 | xAP457 | xAP453 | SalI/Bsu36I | 0.269 | pDB4707 |
| HSA D512A | 74 | xAP458 | xAP453 | SalI/Bsu36I | 0.269 | pDB4708 |
| HSA E565V | 75 | xAP472 | xAP473 | SalI/Bsu36I | 0.269 | pDB4709 |
| HSA A569V | 76 | xAP472 | xAP481 | SalI/Bsu36I | 0.269 | pDB4710 |
| HSA A569L | 77 | xAP472 | xAP482 | SalI/Bsu36I | 0.269 | pDB4711 |
| HSA V576F | 78 | xAP472 | xAP489 | SalI/Bsu36I | 0.269 | pDB4712 |
| HSA R410A | 79 | xAP441 | xAP442 | NcoI/BamHI | 0.562 | pDB4713 |
| HSA Y411A | 80 | xAP441 | xAP443 | NcoI/BamHI | 0.562 | pDB4714 |
| HSA P416A | 81 | xAP441 | xAP444 | NcoI/BamHI | 0.562 | pDB4715 |
| HSA E425A | 82 | xAP441 | xAP445 | NcoI/BamHI | 0.562 | pDB4716 |
| HSA E425K | 83 | xAP441 | xAP446 | NcoI/BamH1 | 0.562 | pDB4717 |
| HSA K524A | 84 | xAP449 | xAP459 | AvrII/SacI | 0.308 | pDB4718 |
| HSA K525A | 85 | xAP449 | xAP460 | AvrII/SacI | 0.308 | pDB4719 |
| HSA K534V | 86 | xAP453 | xAP463 | SacI/Bsu36I | 0.151 | pDB4749 |
| HSA H535F | 87 | xAP453 | xAP471 | SacI/Bsu36I | 0.151 | pDB4720 |
| HSA N503K | 88 | xAP493 | xAP453 | SalI/Bsu36I | 0.269 | pDB4737 |
| HSA E505K | 89 | xAP492 | xAP453 | SalI/Bsu36I | 0.269 | pDB4738 |
| HSA A569S | 90 | xAP472 | xAP494 | SalI/Bsu36I | 0.269 | pDB4740 |
| HSA K466A | 91 | xAP449 | xAP450 | AvrII/SalI | 0.19 | pDB4751 |
| HSA D471A | 92 | xAP449 | xAP451 | AvrII/SalI | 0.19 | pDB4741 |
| HSA R472A | 93 | xAP449 | xAP490 | AvrII/SalI | 0.19 | pDB4742 |
| HSA T527D | 94 | xAP449 | xAP461 | AvrII/SacI | 0.308 | pDB4752 |
| HSA T527M | 95 | xAP449 | xAP495 | AvrII/SacI | 0.308 | pDB4753 |
| HSA T527A | 96 | xAP449 | xAP496 | AvrII/SacI | 0.308 | pDB4754 |
| HSA K190A | 97 | xAP437 | xAP438 | SacII/NheI | 0.395 | pDB4755 |
| HSA R197A | 98 | xAP439 | xAP440 | NheI/NcoI | 0.167 | pDB4748 |

TABLE 11

Mutagenic oligonucleotides

| Oligo | Sequence (5' to 3') | SEQ ID No. |
|---|---|---|
| xAP437 | TGAGTCCGCGGAAAATTGTGACAAATC | 99 |
| xAP438 | GCAGAGCTAGCAGCCCCTTCATCCCGAAG | 100 |
| xAP439 | GGAAGGCTAGCTCTGCCAAACAGGCTCTCAAGTGTGCC | 101 |
| xAP440 | GATCTCCATGGCAGCATTCCGTGTGG | 102 |
| xAP441 | TGCTGCCATGGAGATCTGCTCGAGTGTGC | 103 |

TABLE 11-continued

| Oligo | Sequence (5' to 3') | SEQ ID No. |
|---|---|---|
| | Mutagenic oligonucleotides | |
| xAP442 | CATTTGGATCCCACTTTTCCTAGGTTTCTTGAGACCTCTACAAGAGTTGGAGTTGACACTTGGGGTACTTTCTTGGTGTAAGCAACTAATAGCGC | 104 |
| xAP443 | CATTTGGATCCCACTTTTCCTAGGTTTCTTGAGACCTCTACAAGAGTTGGAGTTGACACTTGGGGTACTTTCTTGGTAGCACGAACTAATAGC | 105 |
| xAP444 | CATTTGGATCCCACTTTTCCTAGGTTTCTTGAGACCTCTACAAGAGTTGGAGTTGACACTTGAGCTACTTTCTTGG | 106 |
| xAP445 | CATTTGGATCCCACTTTTCCTAGGTTTCTTGAGACAGCTACAAGAGTTGG | 107 |
| xAP446 | CATTTGGATCCCACTTTTCCTAGGTTTCTTGAGACTTTTACAAGAGTTGG | 108 |
| xAP449 | AGAAACCTAGGAAAAGTGGGATCCAAATG | 109 |
| xAP450 | TTTCGTCGACTTCCAGAGCTGAAAAGCATGGTCGCCTGTTCACCAAGGATTCTGTGCAGCATTTGGTGACTCTGTCACTTACTGGCGTAGCCTCATGC | 110 |
| xAP451 | GTTTCGTCGACTTCCAGAGCTGAAAAGCATGGTCGCCTGTTCACCAAGGATTCTGTGCAGCATTTGGTGACTCTAGCACTTACTGGCG | 111 |
| xAP452 | CTCTGGAAGTCGACGAAACATACGTTCCCAAAGAGTTTGATGCTGAAACATTCAC | 112 |
| xAP453 | TATTATAAGCCTAAGGCAGCTTGACTTGCAG | 113 |
| xAP455 | CTCTGGAAGTCGACGAAACATACGTTCCCAAAGAGTTTAATGCTGAAACATTCACCTTCGATGCAGATATATGC | 114 |
| xAP456 | CTCTGGAAGTCGACGAAACATACGTTCCCAAAGAGTTTAATGCTGAAACATTCACCTTCGAAGCAGATATATGC | 115 |
| xAP457 | CTCTGGAAGTCGACGAAACATACGTTCCCAAAGAGTTTAATGCTGAAACATTCACCTTCCATGCAGAAATATGCACAC | 116 |
| xAP458 | CTCTGGAAGTCGACGAAACATACGTTCCCAAAGAGTTTAATGCTGAAACATTCACCTTCCATGCAGCTATATGCACAC | 117 |
| xAP459 | TTCACGAGCTCAACAAGTGCAGTTTGTTTAGCGATTTGTCTCTCCTTCTC | 118 |
| xAP460 | TTCACGAGCTCAACAAGTGCAGTTTGAGCCTTGATTTGTCTCTCCTTCTC | 119 |
| xAP461 | TTCACGAGCTCAACAAGTGCATCTTGTTTCTTG | 120 |
| xAP463 | TTGTTGAGCTCGTGGTTCACAAGCCCAAG | 121 |
| xAP471 | TTGTTGAGCTCGTGAAATTTAAGCCCAAGG | 122 |
| xAP472 | CTGGAAGTCGACGAAACATACGTTCCC | 123 |
| xAP473 | ATAAGCCTAAGGCAGCTTGACTTGCAGCAACAAGTTTTTTACCCTCCTCGGCAAAGCAGGTAACCTTATCGTCAG | 124 |
| xAP481 | ATAAGCCTAAGGCAGCTTGACTTGCAGCAACAAGTTTTTTACCCTCCTCAACAAAGCAGGTC | 125 |
| xAP482 | ATAAGCCTAAGGCAGCTTGACTTGCAGCAACAAGTTTTTTACCCTCCTCCAAAAAGCAGGTC | 126 |
| xAP489 | ATAAGCCTAAGGCAGCTTGACTTGCAGCAAAAAGTTTTTTACC | 127 |
| xAP490 | GTTTCGTCGACTTCCAGAGCTGAAAAGCATGGTCGCCTGTTCACCAAGGATTCTGTGCAGCATTTGGTGACAGCGTCACTTACTG | 128 |
| xAP491 | TGGAAGTCGACGAAACATACGTTCCCAAAGAGTTTAATGCTCAAACATTCACC | 129 |
| xAP492 | TGGAAGTCGACGAAACATACGTTCCCAAAGAGTTTAATGCTAAAACATTCACCTTCCATG | 130 |
| xAP493 | TGGAAGTCGACGAAACATACGTTCCCAAAGAGTTTAAAGCTGAAACATTCACCTTCCATG | 131 |
| xAP494 | ATAAGCCTAAGGCAGCTTGACTTGCAGCAACAAGTTTTTTACCCTCCTCAGAAAAGCAGGTCTCCTTATC | 132 |

TABLE 11-continued

| Mutagenic oligonucleotides | | |
|---|---|---|
| Oligo | Sequence (5' to 3') | SEQ ID No. |
| xAP495 | GTTTCACGAGCTCAACAAGTGCCATTTGTTTCTTGATTTGTCTCTCCTTC | 133 |
| xAP496 | GTTTCACGAGCTCAACAAGTGCAGCTTGTTTCTTGATTTGTCTCTCCTTC | 134 |

TABLE 12

| PCR reaction components | |
|---|---|
| HF buffer (5x) | 20 μl |
| dNTP (10 mM) | 2 μl |
| oligo 1 (10 mM) | 2 μl |
| oligo 2 (10 mM) | 2 μl |
| template DNA (5 ng/μl) | 2 μl |
| Phusion (polymerase) | 1 μl |
| $dH_2O$ | 71 μl |

TABLE 13

| PCR reaction conditions | | |
|---|---|---|
| Temperature | Cycle length | Number of cycles |
| 98° C. | 2 min | 1 |
| 98° C. | 10 sec | 35 |
| 55° C. | 30 sec | |
| 72° C. | 20 sec | |
| 72° C. | 10 min | 1 |

Method 2.

If suitable restriction sites were not present in the vicinity of a desired mutation, synthetic DNA fragments were produced by gene assembly (GeneArt, Life Technologies) and were designed to contain mutation(s) within the HSA gene and suitable restriction sites for insertion into the plasmid encoding wild type HSA, pDB3964, such that the nucleotide sequence of the synthetic fragment encoding unchanged amino acids was identical to those in pDB3964 (see Table 14 and 15). The synthetic constructs were digested with the restriction enzymes designated in Table 14, the desired fragments were purified (QIAquick Gel Extraction Kit) and ligated into appropriately digested pDB3964 such that the WT HSA sequence was substituted with the HSA sequence containing the desired mutation. The ligated plasmids were transformed into *E. coli* DH5α cells and plasmids were isolated (Qiagen Plasmid Plus Kit (according to the manufacturer's instructions)). All plasmids were sequenced to confirm that the HSA sequence was only mutated at the desired position(s).

TABLE 14

| Plasmid and amino acid substitution | | | | |
|---|---|---|---|---|
| Mutant | Restriction enzymes | Digested fragment size (kb) | Plasmid | SEQ ID No. (mutant) |
| HSA E531H | SalI/Bsu36I | 0.269 | pDB4739 | 166 |
| HSA E531A | SalI/Bsu36I | 0.269 | pDB4750 | 167 |
| HSA D108A | SacII/NheI | 0.395 | pDB4743 | 168 |
| HSA N111K | SacII/NheI | 0.395 | pDB4744 | 169 |
| HSA N111D | SacII/NheI | 0.395 | pDB4745 | 170 |
| HSA N111G | SacII/NheI | 0.395 | pDB4746 | 171 |
| HSA N111H | SacII/NheI | 0.395 | pDB4747 | 172 |
| HSA K276N | NcoI/BamHI | 0.562 | pDB4756 | 173 |
| HSA N111R | SacII/NheI | 0.395 | pDB4860 | 174 |
| HSA N111Q | SacII/NheI | 0.395 | pDB4861 | 175 |
| HSA N111E | SacII/NheI | 0.395 | pDB4862 | 176 |
| HSA N109D | SacII/NheI | 0.395 | pDB4866 | 177 |
| HSA N109E | SacII/NheI | 0.395 | pDB4867 | 178 |
| HSA N109Q | SacII/NheI | 0.395 | pDB4868 | 179 |
| HSA N109R | SacII/NheI | 0.395 | pDB4869 | 180 |
| HSA N109K | SacII/NheI | 0.395 | pDB4870 | 181 |
| HSA N109H | SacII/NheI | 0.395 | pDB4871 | 182 |
| HSA N109G | SacII/NheI | 0.395 | pDB4872 | 183 |
| HSA D108E | SacII/NheI | 0.395 | pDB4873 | 184 |
| HSA T83N | SacII/NheI | 0.395 | pDB4874 | 156 |
| HSA L575F | SalI/Bsu36I | 0.269 | pDB4875 | 68 |

TABLE 15

| Codons used to introduce amino acid substitutions into HSA. | | | | | |
|---|---|---|---|---|---|
| Amino acid | Codon | Amino acid | Codon | Amino acid | Codon |
| Gly | GGT | Asn | AAT | Leu | TTG |
| Glu | GAA | Met | ATG | Phe | TTT |
| Asp | GAT | Ile | ATT | Ser | TCT |
| Val | GTT | Thr | ACT | Gln | CAA |
| Ala | GCT | Trp | TGG | His | CAT |
| Arg | AGA | Cys | TGT | Pro | CCA |

TABLE 15-continued

| Codons used to introduce amino acid substitutions into HSA. | | | | | |
|---|---|---|---|---|---|
| Amino acid | Codon | Amino acid | Codon | Amino acid | Codon |
| Lys | AAA | Tyr | TAT | Stop | TAA |

Production of Combination Mutants with K573P

Combination mutants (Table 16) were produced to combine a subset of the mutations described in Tables 10 and 14 with the HSA K573P variant (plasmid pDB4110). The 0.358 kb fragment encoding the K573P variant DNA, was isolated from plasmid pDB4110 by digestion with the SacI/SphI restriction enzymes, purified using a QIAquick Gel Extraction Kit and ligated into pDB4704, pDB4716 and pDB4753 (see Table 10) digested with the same enzymes, to produce HSA variants E505Q/K573P, E425A/K573P and T527M/K573P, respectively. Further combination mutants were prepared by digestion of pDB4110 with the NaeI/NcoI restriction enzymes, isolation as described above and ligation of equivalent fragments from pDB4745, pDB4746 and pDB4747 (described in Table 14) to produce combination mutants N111D/K573P, N111G/K573P and N111H/K573P, respectively. To produce the K534V/K573P mutant, synthetic DNA was produced containing both desired mutations by gene assembly (GeneArt, Life Technologies). The fragment was digested via the SalI/Bsu361 restriction sites, isolated as described above and ligated into appropriately digested pDB3964. To produce combination mutants N111R/K573P, N111Q/K573P and N111E/K573P, fragments containing the N111 mutations were removed from GeneArt constructs via the SacII/NheI restriction sites and cloned into appropriately digested pDB3964 containing the SacI/SphI fragment of pDB4110, encoding the K573P mutation (designated pDB4852) as described above. The ligated plasmids were transformed into *E. coli* cells and plasmids were then isolated (Qiagen Plasmid Plus Kit (according to the manufacturer's instructions)). All plasmids underwent sequencing to confirm that the HSA sequence was only mutated at the desired positions.

TABLE 16

| Combination mutants. | | |
|---|---|---|
| Mutant | SEQ ID No. of HSA mutant | Plasmid |
| E425A/K573P | 135 | pDB4849 |
| T527M/K573P | 136 | pDB4850 |
| E505Q/K573P | 137 | pDB4851 |
| N111D/K573P | 138 | pDB4853 |
| N111G/K573P | 139 | pDB4854 |
| N111H/K573P | 140 | pDB4855 |
| N111R/K573P | 141 | pDB4863 |
| N111Q/K573P | 142 | pDB4864 |
| N111E/K573P | 143 | pDB4865 |
| K534V/K573P | 144 | pDB4876 |

Production of Expression Plasmid and Yeast Stocks

Preparation of the expression plasmids and transformation of *S. cerevisiae* was performed as described above, with the modification that cells were plated and subsequently patched onto BMMD plates supplemented with 0.69 g/L CSM-Leu (MP Biomedicals).

Stocks were prepared either by the 48 hour method described above (pDB4703-pDB4720, pDB4737-pDB4756, pDB4849-pDB4855) or the 24 hour method described in WO 2011/051489 (pDB4860-pDB4876), with the modification that BMMS broth (0.17% (w/v) yeast nitrogen base without amino acid and ammonium sulphate (Difco), 37.8 mM ammonium sulphate, 36 mM citric acid, 126 mM disodium hydrogen orthophosphate pH6.5, 2% (w/v) sucrose, adjusted to pH 6.5 with NaOH) was used in both cases.

SPR Analysis

SPR analyses were performed on a Biacore 3000 instrument (G E Healthcare). Immobilisation was carried out on CM5 chips coupled with shFcRn (GeneArt 1025291) using GE Healthcare amine coupling chemistry as per manufacturer's instructions. Immobilised levels of shFcRn-HIS were 1500-2500RU and achieved by injecting 5-10 μg/mL shFcRn into sodium acetate pH5.0 (G E Healthcare). Chip surface was left to stabilize with a constant flow (5 μL/min) of running buffer-HBS-EP buffer (0.01 M HEPES, 0.15 M NaCl, 3 mM EDTA, 0.005% surfactant P20) at pH 7.4 (GE Healthcare))) at 25° C. for ~1-2 hours. After ligand stabilization, the chip surface was primed (×2) with Di-basic/Mono-basic phosphate buffer pH5.5 and conditioned by injecting 5-12×45 μL Di-basic/Mono-basic phosphate buffer at 30 μL/min followed by HBS_EP regeneration steps (12s) in between each injection. Surfaces were then checked for activity by injecting 3×45 μL positive control at 30 μL/min, followed by 12s regeneration pulse. Kinetic measurements were performed by injecting dilutions (100 μM-1 μM) of HSA and HSA variants at 30 μL/min over immobilised shFcRn, at 25° C. The reference cell value was then subtracted and Biaevaluation software 4.1 used to obtain kinetic data and confirm KD values.

The variants were albumin (SEQ ID NO: 2), each with one point mutation selected from: D108A, N111D, N111G, N111H, N111K, K190A, R197A, K276N, R410A, Y411A, P416A, E425A, E425K, K466A, D471A, R472A, N503D, N503K, E505K, E505Q, H510D, H510E, D512A, D512E, K524A, K525A, T527A, T527D, T527M, E531A, E531H, K534V, H535F, E565V, A569L, A569S, A569V, and V576F.

Firstly, the variants were analysed by SPR to determine their binding response (RU) to shFcRn. Only variants showing a binding response more than 20% higher or lower than the binding response of wild-type albumin were analysed to identify the KD (Table 18, below). Wild-type HSA and HSA with mutation K573P were used as controls.

TABLE 18

| Binding affinity of albumin variants to shFcRn-HIS | | | |
|---|---|---|---|
| Molecule | Ka ($10^3$/Ms) | Kd ($10^{-3}$/s) | KD (μM) |
| WT HSA | — | — | 3.1 ± 0.4* |
| HSA_K573P | — | — | 0.4 ± 0.1* |
| E505Q | 2.1 | 2.9 | 1.4 |
| N111D | 0.8 | 4.4 | 5.2 |
| T527M | 2.7 | 3.3 | 1.2 |
| N111G | 1.6 | 5.2 | 3.3 |
| N111H | 0.5 | 2.4 | 5.0 |
| D512E | 2.7 | 10.9 | 4.1 |
| K524A | 3.3 | 11.6 | 3.5 |
| T527A | 2.6 | 13.7 | 5.2 |

TABLE 18-continued

| Binding affinity of albumin variants to shFcRn-HIS | | | |
|---|---|---|---|
| Molecule | Ka ($10^3$/Ms) | Kd ($10^{-3}$/s) | KD (μM) |
| E531H | 3.5 | 20.8 | 6.2 |
| N111K | 0.5 | 8.3 | 17.3 |
| E425K | 3.6 | 12.4 | 3.5 |
| K534V | 4.8 | 5.5 | 1.1 |
| H510D | 0.2 | 0.4 | 2.0 |
| A569S | 0.7 | 4.8 | 6.8 |
| D108A | 0.9 | 12.7 | 13.7 |

*Mean of five repeats, therefore Ka and Kd data are not provided

Variants with a lower KD than wild-type HSA have a higher binding affinity to shFcRn. Conversely, variants with a higher KD than wild-type HSA have a lower binding affinity to shFcRn.

The data for positions 108 and 111 support the involvement of a loop including positions 105 to 120 in interaction with FcRn and therefore predicts that alteration at any position within this loop will modulate the binding affinity of albumin to FcRn.

Example 7

SPR Analysis of Binding Affinity of Albumin Variants to shFcRn-HIS

The variants were albumin (SEQ ID NO: 2), each with one point mutation selected from: N111D, N111G, N111H, N111D/K573P, N111G/K573P, N111H/K573P, E505Q, E425A, T527M, E505Q/K573P, E425 Å/K573P and T527M/K573P were prepared as described above.

TABLE 19

| Binding affinity of albumin variants to shFcRn-HIS | | | | | | |
|---|---|---|---|---|---|---|
| Molecule | Ka ($10^3$/Ms) | | Kd ($10^{-3}$/s) | | KD (μM) | |
| WT rHSA | — | | — | | 3.6 ± 0.54* | |
| rHSA_K573P | — | | — | | 0.6 ± 0.12** | |
| N111D | 9.8 | 9.1 | 17.9 | 17.9 | 1.8 | 2.0 |
| N111G | 7.4 | 7.4 | 20.5 | 19.2 | 2.7 | 2.6 |
| N111H | 4.4 | 4.0 | 15.6 | 14.2 | 3.5 | 3.6 |
| N111D-K573P | 4.0 | 4.2 | 1.9 | 2.2 | 0.5 | 0.5 |
| N111G-K573P | 4.1 | 4.7 | 1.7 | 2.3 | 0.4 | 0.5 |
| N111H-K573P | 2.9 | 3.0 | 1.7 | 2.2 | 0.6 | 0.7 |
| E505Q | 5.1 | 5.0 | 4.9 | 6.0 | 1.0 | 1.2 |
| E425A | 6.6 | 7.9 | 34.1 | 28.1 | 5.1 | 3.6 |
| T527M | 4.9 | 4.8 | 4.4 | 5.1 | 0.9 | 1.1 |
| E425A-K573P | 3.4 | 3.6 | 2.5 | 3.2 | 0.7 | 0.9 |
| E505Q-K573P | 0.4 | 0.4 | 0.5 | 1.1 | 1.6 | 2.5 |
| T527M-K573P | 2.6 | 2.8 | 1.2 | 2.2 | 0.5 | 0.8 |

*Mean of 8 and standard deviation

**Mean of 5 and standard deviation.

Variants with a lower KD than wild-type HSA have a higher binding affinity to shFcRn. Conversely, variants with a higher KD than wild-type HSA have a lower binding affinity to shFcRn.

The data for including K573P generate increases in affinity consistent with the K573P substitution only.

Example 8

SPR Analysis of Binding Affinity of Albumin Variants to shFcRn-HIS

The variants were albumin (SEQ ID NO: 2), each with one point mutation selected from: N111R, N111Q, N111E, N111R/K573P, N111Q/K573P, N111E/K573P, N109D, N109E, N109Q, N109R, N109K, N109H, N109G, D108E, T83N, L575F and K534V/K573P were prepared as described above.

TABLE 20

| Binding affinity of albumin variants to shFcRn-HIS | | | | | | |
|---|---|---|---|---|---|---|
| Molecule | Ka ($10^3$/Ms) | | Kd ($10^{-3}$/s) | | KD (μM) | |
| WT rHA | — | | — | | 2.0 ± 0.3* | |
| rHA_K573P | — | | — | | 0.3 ± 0.0** | |
| N111E | 15.3 | 14.3 | 13.1 | 15.2 | 0.8 | 1.1 |
| N111E-K573P | 4.2 | — | 2.4 | — | 0.6 | — |
| N109K | 9.7 | 6.3 | 18.3 | 21.6 | 1.9 | 3.4 |
| D108E | 13.9 | 7.5 | 16.6 | 19.5 | 1.2 | 2.6 |
| T83N | 17.7 | 15.2 | 15.6 | 16.8 | 0.9 | 1.1 |
| L575F | 11.8 | 8.3 | 31.3 | 32.2 | 2.7 | 4.0 |
| K534V-K573P | 4.7 | 4.5 | 6.9 | 6.9 | 1.5 | 1.5 |

*Mean of 11 and standard deviation

**Mean of 5 and standard deviation.

The data demonstrate a role for the 108-111 loop in binding of HSA to FcRn, with reduced binding affinity observed in the D108A and N111K variants (Table 18). Additional mutations at position 111 demonstrated a range of binding affinities, from the reduced affinity observed for the N111K variant through to the N111E variant, which displayed an increased affinity for FcRn as compared to WT HSA (Table 20). Variant N111Q/K573P (FIG. 23) shows a binding curve with increased response and reduced dissociation consistent with the K573P substitution. The relative position of loop region 108-112 of HSA and FcRn (FIG. 24) suggests that this region has potential to contribute to FcRn binding as predicted in Example 6.

The relative position of adjacent loop region of Domain 1, comprising residues 78-88 (FIG. 24), suggests that this region has potential to contribute to FcRn binding. This is supported by the observation that the T83N variant shows increased affinity for FcRn compared to WT HSA (Table 20).

Mutation of the adjacent residues, particularly E82, P110 and L112 (FIG. 24), would be predicted to alter the binding affinity of HSA for FcRn.

The invention described and claimed herein is not to be limited in scope by the specific aspects herein disclosed, since these aspects are intended as illustrations of several aspects of the invention. Any equivalent aspects are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

REFERENCES FROM EXAMPLES 1, 2 AND 3

1. Peters T, Jr. (1985) Serum albumin. Adv Protein Chem 37:161-245.
2. Chaudhury C, et al. (2003) The major histocompatibility complex-related Fc receptor for IgG (FcRn) binds albumin and prolongs its lifespan. J Exp Med 197 (3):315-322.
3. Anderson C L, et al. (2006) Perspective—FcRn transports albumin: relevance to immunology and medicine. Trends Immunol 27 (7):343-348.
4. Roopenian D C & Akilesh S (2007) FcRn: the neonatal Fc receptor comes of age. Nat Rev Immunol 7 (9):715-725.

5. Ward E S & Ober R J (2009) Chapter 4: Multitasking by exploitation of intracellular transport functions the many faces of FcRn. Adv Immunol 103:77-115.

6. Burmeister W P, Huber A H, & Bjorkman P J (1994) Crystal structure of the complex of rat neonatal Fc receptor with Fc. Nature 372 (6504):379-383.

7. Burmeister W P, Gastinel L N, Simister N E, Blum M L, & Bjorkman P J (1994) Crystal structure at 2.2 A resolution of the MHC-related neonatal Fc receptor. Nature 372 (6504): 336-343.

8. West A P, Jr. & Bjorkman P J (2000) Crystal structure and immunoglobulin G binding properties of the human major histocompatibility complex-related Fc receptor. Biochemistry 39 (32):9698-9708.

9. Chaudhury C, Brooks C L, Carter D C, Robinson J M, & Anderson C L (2006) Albumin binding to FcRn: distinct from the FcRn-IgG interaction. Biochemistry 45 (15): 4983-4990.

10. Ober R J, Martinez C, Lai X, Zhou J, & Ward E S (2004) Exocytosis of IgG as mediated by the receptor, FcRn: an analysis at the single-molecule level. Proc Natl Acad Sci USA 101 (30):11076-11081.

11. Ober R J, Martinez C, Vaccaro C, Zhou J, & Ward E S (2004) Visualizing the site and dynamics of IgG salvage by the MHC class I-related receptor, FcRn. J Immunol 172 (4):2021-2029.

12. Prabhat P, et al. (2007) Elucidation of intracellular recycling pathways leading to exocytosis of the Fc receptor, FcRn, by using multifocal plane microscopy. Proc Natl Acad Sci USA 104 (14):5889-5894.

13. Roopenian D C, et al. (2003) The MHC class I-like IgG receptor controls perinatal IgG transport, IgG homeostasis, and fate of IgG-Fc-coupled drugs. J Immunol 170 (7): 3528-3533.

14. Montoyo H P, et al. (2009) Conditional deletion of the MHC class I-related receptor FcRn reveals the sites of IgG homeostasis in mice. Proc Natl Acad Sci USA 106 (8): 2788-2793.

15. Wani M A, et al. (2006) Familial hypercatabolic hypoproteinemia caused by deficiency of the neonatal Fc receptor, FcRn, due to a mutant beta2-microglobulin gene. Proc Natl Acad Sci USA 103 (13):5084-5089.

16. Minchiotti L, Galliano M, Kragh-Hansen U, & Peters T, Jr. (2008) Mutations and polymorphisms of the gene of the major human blood protein, serum albumin. Hum Mutat 29 (8):1007-1016.

17. Andersen J T, Daba M B, & Sandlie I (2010) FcRn binding properties of an abnormal truncated analbuminemic albumin variant. Clin Biochem 43 (4-5):367-372.

18. Andersen J T & Sandlie I (2007) A receptor-mediated mechanism to support clinical observation of altered albumin variants. Clin Chem 53 (12):2216.

19. Sugio S, Kashima A, Mochizuki S, Noda M, & Kobayashi K (1999) Crystal structure of human serum albumin at 2.5 A resolution. Protein Eng 12 (6):439-446.

20. Peach R J & Brennan S O (1991) Structural characterization of a glycoprotein variant of human serum albumin: albumin Casebrook (494 Asp-Asn). Biochim Biophys Acta 1097 (1):49-54.

21. Andersen J T, Daba M B, Berntzen G, Michaelsen T E, & Sandlie I (2010) Cross-species binding analyses of mouse and human neonatal Fc receptor show dramatic differences in immunoglobulin G and albumin binding. J Biol Chem 285 (7):4826-4836.

22. Andersen J T, Dee Qian J, & Sandlie I (2006) The conserved histidine 166 residue of the human neonatal Fc receptor heavy chain is critical for the pH-dependent binding to albumin. Eur J Immunol 36 (11):3044-3051.

23. Mezo A R, Sridhar V, Badger J, Sakorafas P, & Nienaber V (2010) X-ray crystal structures of monomeric and dimeric peptide inhibitors in complex with the human neonatal Fc receptor, FcRn. Biol Chem 285 (36):27694-27701.

24. Sheffield W P, Marques J A, Bhakta V, & Smith I J (2000) Modulation of clearance of recombinant serum albumin by either glycosylation or truncation. Thromb Res 99 (6):613-621.

25. Kenanova V E, et al. (2010) Tuning the serum persistence of human serum albumin domain III:diabody fusion proteins. Protein Eng Des Sel 23 (10):789-798.

26. Simard J R, et al. (2005) Locating high-affinity fatty acid-binding sites on albumin by x-ray crystallography and NMR spectroscopy. Proc Natl Acad Sci USA 102 (50): 17958-17963.

27. Curry S, Mandelkow H, Brick P, & Franks N (1998) Crystal structure of human serum albumin complexed with fatty acid reveals an asymmetric distribution of binding sites. Nat Struct Biol 5 (9):827-835.

28. Kuo T T, et al. (2010) Neonatal Fc receptor: from immunity to therapeutics. J Clin Immunol 30 (6):777-789.

29. Andersen J T & Sandlie I (2009) The versatile MHC class I-related FcRn protects IgG and albumin from degradation: implications for development of new diagnostics and therapeutics. Drug Metab Pharmacokinet 24 (4):318-332.

30. Werle M & Bernkop-Schnurch A (2006) Strategies to improve plasma half life time of peptide and protein drugs. Amino Acids 30 (4):351-367.

31. McGregor D P (2008) Discovering and improving novel peptide therapeutics. Curr Opin Pharmacol 8 (5):616-619.

32. Zalevsky J, et al. (2010) Enhanced antibody half-life improves in vivo activity. Nat Biotechnol 28 (2):157-159.

33. Stehle G, et al. (1997) Plasma protein (albumin) catabolism by the tumor itself—implications for tumor metabolism and the genesis of cachexia. Crit Rev Oncol Hematol 26 (2):77-100.

34. Kenanova V, et al. (2005) Tailoring the pharmacokinetics and positron emission tomography imaging properties of anti-carcinoembryonic antigen single-chain Fv-Fc antibody fragments. Cancer Res 65 (2):622-631.

35. Kenanova V, et al. (2007) Radioiodinated versus radiometal-labeled anti-carcinoembryonic antigen single-chain Fv-Fc antibody fragments: optimal pharmacokinetics for therapy. Cancer Res 67 (2):718-726.

36. Andersen J T, et al. (2008) Ligand binding and antigenic properties of a human neonatal Fc receptor with mutation of two unpaired cysteine residues. FEBS J 275 (16):4097-4110.

37. Chen R, Li L, & Weng Z (2003) ZDOCK: an initial-stage protein-docking algorithm. Proteins 52 (1):80-87.

SEQUENCE LISTING (184 sequences)

SEQ ID NO: 1 - DNA, 1758 bp, Homo sapiens
  misc_feature (1)..(1758): cDNA encoding HSA
gatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataa

SEQ ID NO: 2 - protein, 585 aa, Homo sapiens [sequence omitted]

SEQ ID NO: 3 - protein, 585 aa, Artificial Sequence
  HSA K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 4 - protein, 609 aa, Homo sapiens [sequence omitted]

SEQ ID NO: 5 - protein, 621 aa, Pan troglodytes
MNESSCCSTSLPAFGVSVLDSGHSSSSAYSRGVFRRDAHKSEVAHRFKDLGEENFKALVLVAFAQYLQQCPFEDHVKLVNEVTEFAKTCVADESAENCDKSLHTLFGDKLCTVATLREKYGEMADCCAKQEPERNECFLQHKDDNPNLPRLVRPEVDVMCTAFHDNEGTFLKKYLYEVARRHPYFYAPELLFFAERYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCLAEVENDEMPADLPSLAADFVESKEVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 6 - protein, 608 aa, Macaca mulatta
MKWVTFISLLFLFSSAYSRGVFRRDTHKSEVAHRFKDLGEEHFKGLVLVAFSQYLQQCPFEEHVKLVNEVTEFAKTCVADESAENCDKSLHTLFGDKLCTVATLRETYGEMADCCAKQEPERNECFLQHKDDNPNLPPLVRPEVDVMCTAFHDNEATFLKKYLYEVARRHPYFYAPELLFFAARYKAAFAECCQAADKAACLLPKLDELRDEGKASSAKQRLKCASLQKFGDRAFKAWAVARLSQKFPKAEFAEVSKLVTDLTKVHTECCHGDLLECADDRADLAKYMCENQDSISSKLKECCDKPLLEKSHCLAEVENDEMPADLPSLAADYVESKDVCKNYAEAKDVFLGMFLYEYARRHPDYSVMLLLRLAKAYEATLEKCCAAADPHECYAKVFDEFQPLVEEPQNLVKQNCELFEQLGEYKFQNALLVRYTKKVPQVSTPTLVEVSRNLGKVGAKCCKLPEAKRMPCAEDYLSVVLNRLCVLHEKTPVSEKVTKCCTESLVNRRPCFSALELDEAYVPKAFNAETFTFHADMCTLSEKEKQVKKQTALVELVKHKPKATKEQLKGVMDNFAAFVEKCCKADDKEACFAEEGPKFVAASQAALA

SEQ ID NO: 7 - protein, 608 aa, Mesocricetus auratus
MKWVTFLLLLFVSDSAFSRGLFRRDAHKSEIAHRFKDLGEQHFKGLVLIAFSQFLQKCPYEEHVKLVNEVTDFAKTCVADESAENCDKSLHTLFGDKLCAIPTLRDSYGELADCCAKKEPERNECFLKHKDDHPNLPPFVRPDAEAMCTSFQENAVTFMGHYLHEVARRHPYFYAPELLYYAEKYSAIMTECCGEADKAACITPKLDALKEKALASSVNQRLKCSSLQRFGQRAFKAWAVARMSQKFPKADFAEITKLATDLTKLTEECCHGDLLECADDRAELAKYMCENQASISSKLQACCDKPVLKKSHCLSEVENDDLPADLPSLAADFVEDKEVCKNYAEAKDVFLGTFLYEYARRHPDYSVALLLRLAKKYEATLEKCCAEADPSACYGKVLDEFQPLVEEPKNLVKANCELFEKLGEYGFQNALIVRYTQKAPQVSTPTLVEAARNLGKVGSKCCVLPEAQRLPCVEDYISAILNRVCVLHEKTPVSEQVTKCCTGSVVERRPCFSALPVDETYVPKEFKAETFTFHADICSLPEKEKQMKKQAALVELVKHKPKATGPQLRTVLGEFTAFLDKCCKAEDKEACFSEDGPKLVASSQAALA

SEQ ID NO: 8 - protein, 608 aa, Cavia porcellus
MKWVTFISLLFLFSSVYSRGVFRREAHKSEIAHRFNDLGEGHFKGLVLITLSQHLQKSPFEEHVKLVNEVTDFAKACVADESAQNCGKAIATLFGDKVCAIPSLRETYGELADCCAKEDPDRVECFLQHKDDNPNLPPFERPEPEALCTAFKENNDRFIGHYLYEVSRRHPYFYAPELLYYAEKYKNALTECCEAADKAACLTPKLDAIKEKALVSSAQQRLKCASLQKFGERAFKAWSVARLSQKFPKAEFAEISTIVTSLTKVTKECCHGDLLECADDRQELAKYMCEHQDSISSKLKECCVKPTLQKAHCILEIQRDELPTELPDLAVDFVEDKEVCKNFAEAKDVFLGTFLYEYSRRHPEYSIGMLLRIAKGYEAKLEKCCAEADPHACYAKVFDELQPLIDEPKKLVQQNCELFDKLGEYGFQNALAVRYTQKAPQVSTPTLVEYARKLGSVGTKCCSLPETERLSCTENYLALILNRLCILHEKTPVSERVTKCCTESLVNRRPCFSALHVDETYVPKPFHADSFTFHADICTLPEKEKQVKKQMALVELVKHKPKASEEQMKTVMGDFAAFLKKCCDADNKEACFTEDGPKLVAKCQATLA

SEQ ID NO: 9 - protein, 608 aa, Mus musculus
MKWVTFLLLLFVSGSAFSRGVFRREAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALA

SEQ ID NO: 10 - protein, 608 aa, Rattus norvegicus
MKWVTFLLLLFISGSAFSRGVFRREAHKSEIAHRFKDLGEQHFKGLVLIAFSQYLQKCPYEEHIKLVQEVTDFAKTCVADENAENCDKSIHTLFGDKLCAIPKLRDNYGELADCCAKQEPERNECFLQHKDDNPNLPPFQRPEAEAMCTSFQENPTSFLGHYLHEVARRHPYFYAPELLYYAEKYNEVLTQCCTESDKAACLTPKLDAVKEKALVAAVRQRMKCSSMQRFGERAFKAWAVARMSQRFPNAEFAEITKLATDVTKINKECCHGDLLECADDRAELAKYMCENQATISSKLQACCDKPVLQKSQCLAEIEHDNIPADLPSIAADFVEDKEVCKNYAEAKDVFLGTFLYEYSRRHPDYSVSLLLRLAKKYEATLEKCCAEGDPPACYGTVLAEFQPLVEEPKNLVKTNCELYEKLGEYGFQNAVLVRYTQKAPQVSTPTLVEAARNLGRVGTKCCTLPEAQRLPCVEDYLSAILNRLCVLHEKTPVSEKVTKCCSGSLVERRPCFSALTVDETYVPKEFKAETFTFHSDICTLPDKEKQIKKQTALAELVKHKPKATEDQLKTVMGDFAQFVDKCCKAADKDNCFATEGPNLVARSKEALA

SEQ ID NO: 11 - protein, 607 aa, Bos taurus
MKWVTFISLLLLFSSAYSRGVFRRDTHKSEIAHRFKDLGEEHFKGLVLIAFSQYLQQCPFDEHVKLVNELTEFAKTCVADESHAGCEKSLHTLFGDELCKVASLRETYGDMADCCEKQEPERNECFLSHKDDSPDLPKLKPDPNTLCDEFKADEKKFWGKYLYEIARRHPYFYAPELLYYANKYNGVFQECCQAEDKGACLLPKIETMREKVLASSARQRLRCASIQKFGERALKAWSVARLSQKFPKAEFVEVTKLVTDLTKVHKECCHGDLLECADDRADLAKYICDNQDTISSKLKECCDKPLLEKSHCIAEVEKDAIPENLPPLTADFAEDKDVCKNYQEAKDAFLGSFLYEYSRRHPEYAVSVLLRLAKEYEATLEECCAKDDPHACYSTVFDKLKHLVDEPQNLIKQNCDQFEKLGEYGFQNALIVRYTRKVPQVSTPTLVEVSRSLGKVGTRCCTKPESERMPCTEDYLSLILNRLCVLHEKTPVSEKVTKCCTESLVNRRPCFSALTPDETYVPKAFDEKLFTFHADICTLPDTEKQIKKQTALVELLKHKPKATEEQLKTVMENFVAFVDKCCAADDKEACFAVEGPKLVVSTQTALA

SEQ ID NO: 12 - protein, 607 aa, Equus caballus
MKWVTFVSLLFLFSSAYSRGVLRRDTHKSEIAHRFNDLGEKHFKGLVLVAFSQYLQQCPFEDHVKLVNEVTEFAKKCAADESAENCDKSLHTLFGDKLCTVATLRATYGELADCCEKQEPERNECFLTHKDDHPNLPKLKPEPDAQCAAFQEDPDKFLGKYLYEVARRHPYFYGPELLFHAEEYKADFTECCPADDKLACLIPKLDALKERILLSSAKERLKCSSFQNFGERAVKAWSVARLSQKFPKADFAEVSKIVTDLTKVHKECCHGDLLECADDRADLAKYICEHQDSISGKLKACCDKPLLQKSHCIAEVKEDDLPSDLPALAADFAEDKEICKHYKDAKDVFLGTFLYEYSRRHPDYSVSLLLRIAKTYEATLEKCCAEADPPACYRTVFDQFTPLVEEPKSLVKKNCDLFEEVGEYDFQNALIVRYTKKAPQVSTPTLVEIGRTLGKVGSRCCKLPESERLPCSENHLALALNRLCVLHEKTPVSEKITKCCTDSLAERRPCFSALELDEGYVPKEFKAETFTFHADICTLPEDEKQIKKQSALAELVKHKPKATKEQLKTVLGNFSAFVAKCCGREDKEACFAEEGPKLVASSQLALA

SEQ ID NO: 13 - protein, 607 aa, Equus asinus
MKWVTFVSLLFLFSSAYFRGVLRRDTHKSEIAHRFNDLGEKHFKGLVLVAFSQYLQQCPFEDHVKLVNEVTEFAKKCAADESAENCDKSLHTLFGDKLCTVATLRATYGELADCCEKQEPERNECFLTHKDDHPNLPKLKPEPDAQCAAFQEDPDKFLGKYLYEVARRHPYFYGPELLFHAEEYKADFTECCPADDKAGCLIPKLDALKERILLSSAKERLKCSSFQKFGERAFKAWSVARLSQKFPKADFAEVSKIVTDLTKVHKECCHGDLLECADDRADLTKYICEHQDSISGKLKACCDKPLLQKSHCIAEVKEDDLPSDLPALAADFAEDKEICKHYKDAKDVFLGTFLYEYSRRHPDYSVSLLLRIAKTYEATLEKCCAEADPPACYATVFDQFTPLVEEPKSLVKKNCDLFEEVGEYDFQNALIVRYTKKAPQVSTPTLVEIGRTLGKVGSRCCKLPESERLPCSENHLALALNRLCVLHEKTPVSEKITKCCTDSLAERRPCFSALELDEGYIPKEFKAETFTFHADICTLPEDEKQIKKQSALAELVKHKPKATKEQLKTVLGNFSAFVAKCCGAEDKEACFAEEGPKLVASSQLALA

SEQ ID NO: 14 - protein, 608 aa, Oryctolagus cuniculus
MKWVTFISLLFLFSSAYSRGVFRREAHKSEIAHRFNDVGEEHFIGLVLITFSQYLQKCPYEEHAKLVKEVTDLAKACVADESAANCDKSLHDIFGDKICALPSLRDTYGDVADCCEKKEPERNECFLHHKDDKPDLPPFARPEADVLCKAFHDDEKAFFGHYLYEVARRHPYFYAPELLYYAQKYKAILTECCEAADKGACLTPKLDALEGKSLISAAQERLRCASIQKFGDRAYKAWALVRLSQRFPKADFTDISKIVTDLTKVHKECCHGDLLECADDRADLAKYMCEHQETISSHLKECCDKPILEKAHCIYGLHNDETPAGLPAVAEEFVEDKDVCKNYEEAKDLFLGKFLYEYSRRHPDYSVVLLLRLGKAYEATLKKCCATDDPHACYAKVLDEFQPLVDEPKNLVKQNCELYEQLGDYNFQNALLVRYTKKVPQVSTPTLVEISRSLGKVGSKCCKHPEAERLPCVEDYLSVVLNRLCVLHEKTPVSEKVTKCCSESLVDRRPCFSALGPDETYVPKEFNAETFTFHADICTLPETERKIKKQTALVELVKHKPHATNDQLKTVVGEFTALLDKCCSAEDKEACFAVEGPKLVESSKATLG

SEQ ID NO: 15 - protein, 583 aa, Capra hircus
DTHKSEIAHRFNDLGEENFQGLVLIAFSQYLQQCPFDEHVKLVKELTEFAKTCVADESHAGCDKSLHTLFGDELCKVATLRETYGDMADCCEKQEPERNECFLKHKDDSPDLPKLKPEPDTLCAEFKADEKKFWGKYLYEVARRHPYFYAPELLYYANKYNGVFQECCQAEDKGACLLPKIETMREKVLASSARQRLRCASIQKFGERALKAWSVARLSQKFPKADFTDVTKIVTDLTKVHKECCHGDLLECADDRADLAKYICDHQDTLSSKLKECCDKPVLEKSHCIAEIDKDAVPENLPPLTADFAEDKEVCKNYQEAKDVFLGSFLYEYSRRHPEYAVSVLLRLAKEYEATLEDCCAKEDPHACYATVFDKLKHLVDEPQNLIKKNCELFEKHGEYGFQNALIVRYTRKAPQVSTPTLVEISRSLGKVGTKCCAKPESERMPCTEDYLSLILNRLCVLHEKTPVSEKVTKCCTESLVNRRPCFSDLTLDETYVPKPFDGESFTFHADICTLPDTEKQIKKQTALVELLKHKPKATDEQLKTVMENFVAFVDKCCAADDKEGCFLLEGPKLVASTQAALA

SEQ ID NO: 16 - protein, 607 aa, Ovis aries
MKWVTFISLLLLFSSAYSRGVFRRDTHKSEIAHRFNDLGEENFQGLVLIAFSQYLQQCPFDEHVKLVKELTEFAKTCVADESHAGCDKSLHTLFGDELCKVATLRETYGDMADCCEKQEPERNECFLNHKDDSPDLPKLKPEPDTLCAEFKADEKKFWGKYLYEVARRHPYFYAPELLYYANKYNGVFQECCQAEDKGACLLPKIDAMREKVLASSARQRLRCASIQKFGERALKAWSVARLSQKFPKADFTDVTKIVTDLTKVHKECCHGDLLECADDRADLAKYICDHQDALSSKLKECCDKPVLEKSHCIAEVDKDAVPENLPPLTADFAEDKEVCKNYQEAKDVFLGSFLYEYSRRHPEYAVSVLLRLAKEYEATLEDCCAKEDPHACYATVFDKLKHLVDEPQNLIKKNCELFEKHGEYGFQNALIVRYTRKAPQVSTPTLVEISRSLGKVGTKCCAKPESERMPCTEDYLSLILNRLCVLHEKTPVSEKVTKCCTESLVNRRPCFSDLTLDETYVPKPFDEKFFTFHADICTLPDTEKQIKKQTALVELLKHKPKATDEQLKTVMENFVAFVDKCCAADDKEGCFVLEGPKLVASTQAALA

SEQ ID NO: 17 - protein, 608 aa, canis lupus familiaris
MKWVTFISLFFLFSSAYSRGLVRREAYKSEIAHRYNDLGEEHFRGLVLVAFSQYLQQCPFEDHVKLAKEVTEFAKACAAEESGANCDKSLHTLFGDKLCTVASLRDKYGDMADCCEKQEPDRNECFLAHKDDNPGFPPLVAPEPDALCAAFQDNEQLFLGKYLYEIARRHPYFYAPELLYYAQQYKGVFAECCQAADKAACLGPKIEALREKVLLSSAKERFKCASLQKFGDRAFKAWSVARLSQRFPKADFAEISKVVTDLTKVHKECCHGDLLECADDRADLAKYMCENQDSISTKLKECCDKPVLEKSQCLAEVERDELPGDLPSLAADFVEDKEVCKNYQEAKDVFLGTFLYEYARRHPEYSVSLLLRLAKEYEATLEKCCATDDPPTCYAKVLDEFKPLVDEPQNLVKTNCELFEKLGEYGFQNALLVRYTKKAPQVSTPTLVEVSRKLGKVGTKCCKKPESERMSCAEDFLSVVLNRLCVLHEKTPVSERVTKCCSESLVNRRPCFSGLEVDETYVPKEFNAETFTFHADLCTLPEAEKQVKKQTALVELLKHKPKATDEQLKTVMGDFGAFVEKCCAAENKEGCFSEEGPKLVAAAQAALV

SEQ ID NO: 18 - protein, 615 aa, Gallus gallus
MKWVTLISFIFLFSSATSRNLQRFARDAEHKSEIAHRYNDLKEETFKAVAMITFAQYLQRCSYEGLSKLVKDVVDLAQKCVANEDAPECSKPLPSIILDEICQVEKLRDSYGAMADCCSKADPERNECFLSFKVSQPDFVQPYQRPASDVICQEYQDNRVSFLGHFIYSVARRHPFLYAPAILSFAVDFEHALQSCCKESDVGACLDTKEIVMREKAKGVSVKQQYFCGILKQFGDRVFQARQLIYLSQKYPKAPFSEVSKFVHDSIGVHKECCEGDMVECMDDMARMMSNLCSQQDVFSGKIKDCCEKPIVERSQCIMEAEFDEKPADLPSLVEKYIEDKEVCKSFEAGHDAFMAEFVYEYSRRHPEFSIQLIMRIAKGYESLLEKCCKTDNPAECYANAQEQLNQHIKETQDVVKTNCDLLHDHGEADFLKSILIRYTKKMPQVPTDLLLETGKKMTTIGTKCCQLGEDRRMACSEGYLSIVIHDTCRKQETTPINDNVSQCCSQLYANRRPCFTAMGVDTKYVPPPFNPDMFSFDEKLCSAPAEEREVGQMKLLINLIKRKPQMTEEQIKTIADGFTAMVDKCCKQSDINTCFGEEGANLIVQSRATLGIGA

SEQ ID NO: 19 - protein, 607 aa, Sus scrofa
MKWVTFISLLFLFSSAYSRGVFRRDTYKSEIAHRFKDLGEQYFKGLVLIAFSQHLQQCPYEEHVKLVREVTEFAKTCVADESAENCDKSIHTLFGDKLCAIPSLREHYGDLADCCEKEEPERNECFLQHKNDNPDIPKLKPDPVALCADFQEDEQKFWGKYLYEIARRHPYFYAPELLYYAIIYKDVFSECCQAADKAACLLPKIEHLREKVLTSAAKQRLKCASIQKFGERAFKAWSLARLSQRFPKADFTEISKIVTDLAKVHKECCHGDLLECADDRADLAKYICENQDTISTKLKECCDKPLLEKSHCIAEAKRDELPADLNPLEHDFVEDKEVCKNYKEAKHVFLGTFLYEYSRRHPDYSVSLLLRIAKIYEATLEDCCAKEDPPACYATVFDKFQPLVDEPKNLIKQNCELFEKLGEYGFQNALIVRYTKKVPQVSTPTLVEVARKLGLVGSRCCKRPEEERLSCAEDYLSLVLNRLCVLHEKTPVSEKVTKCCTESLVNRRPCFSALTPDETYKPKEFVEGTFTFHADLCTLPEDEKQIKKQTALVELLKHKPHATEEQLRTVLGNFAAFVQKCCAAPDHEACFAVEGPKFVIEIRGILA

SEQ ID NO: 20 - protein, 584 aa, artificial sequence
  N terminal is residues 1 to 572 of HSA. C terminal is residues 573 to 584 of Macaque albumin.
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKFVAASQAALA

SEQ ID NO: 21 - protein, 584 aa, Artificial Sequence
  N terminal is residues 1 to 572 from HSA. C terminal is residues 573 to 584 from mouse albumin.
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPNLVTRCKDALA

SEQ ID NO: 22 - protein, 584 aa, Artificial Sequence
  N terminal is residues 1 to 572 of HSA. C terminal is residues 573 to 584 of rabbit albumin.
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVESSKATLG

SEQ ID NO: 23 - protein, 584 aa, Artificial Sequence
  N-terminal is residues 1 to 572 of HSA. C-terminal is residues 573 to 583 of sheep albumin.
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVASTQAALA

SEQ ID NO: 24 - protein, 399 aa, Artificial sequence
  Artificial albumin variant: human serum albumin domain 1 and human serum albumin domain 3
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 25 - protein, 403 aa, Artificial sequence
  Artificial albumin variant: human serum albumin domain 2 and human serum albumin domain 3
DELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 26 - protein, 410 aa, Artificial sequence
  Artificial albumin variant: two consecutive copies of human serum albumin domain 3
VEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 27 - protein, 205 aa, Artificial sequence [sequence omitted]

SEQ ID NO: 28 - protein, 615 aa, Artificial Sequence
  HSA Domain III + HSA Domain III + HSA Domain III
VEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 29 - protein, 604 aa, Artificial Sequence
  HSA Domain I + HSA Domain III + HSA Domain III
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 30 - protein, 290 aa, Homo sapiens
  misc_feature (1)..(290): Truncated heavy chain of the major histocompatibility complex class I-like Fc receptor (FCGRT) (together, SEQ ID No. 30 and SEQ ID No. 31 form FcRN)
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVEL

SEQ ID NO: 31 - protein, 119 aa, Homo sapiens
  misc_feature (1)..(119): Beta-2-microglobulin (together, SEQ ID No. 30 and SEQ ID No. 31 form FcRN)
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 32 - protein, 584 aa, Artificial sequence
  HSA 585stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALG

SEQ ID NO: 33 - protein, 583 aa, Artificial sequence
  HSA 584stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAAL

SEQ ID NO: 34 - protein, 582 aa, Artificial sequence
  HSA 583stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAA

SEQ ID NO: 35 - protein, 581 aa, Artificial sequence
  HSA 582stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQA

SEQ ID NO: 36 - protein, 580 aa, Artificial sequence
  HSA 581stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQ

SEQ ID NO: 37 - protein, 579 aa, Artificial sequence
  HSA 580stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAAS

SEQ ID NO: 38 - protein, 578 aa, Artificial sequence
  HSA 579stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAA

SEQ ID NO: 39 - protein, 577 aa, Artificial sequence
  HSA 578stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVA

SEQ ID NO: 40 - protein, 576 aa, Artificial sequence
  HSA 577stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLV

SEQ ID NO: 41 - protein, 575 aa, Artificial sequence
  HSA 576stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKL

SEQ ID NO: 42 - protein, 574 aa, Artificial sequence
  HSA 575stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKK

SEQ ID NO: 43 - protein, 573 aa, Artificial sequence
  HSA 574stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGK

SEQ ID NO: 44 - protein, 571 aa, Artificial sequence
  HSA 572stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEE

SEQ ID NO: 45 - protein, 567 aa, Artificial sequence
  HSA 568stop
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETC

SEQ ID NO: 46 - DNA, 17 bp, Artificial sequence
  Oligonucleotide: xAP265
gctcgcctgagccagag

SEQ ID NO: 47 - DNA, 30 bp, Artificial sequence
  Oligonucleotide: xAP294
gaattaagcttattattagcctaaggcagc

SEQ ID NO: 48 - DNA, 30 bp, Artificial sequence
  Oligonucleotide: xAP295
gaattaagcttattataattataaggcagc

SEQ ID NO: 49 - DNA, 33 bp, Artificial sequence
  Oligonucleotide: xAP296
gaattaagcttattataagccttaggcagcttg

SEQ ID NO: 50 - DNA, 39 bp, Artificial sequence
  Oligonucleotide: xAP297
gaattaagcttattataagcctaattaggcttgacttgc

SEQ ID NO: 51 - DNA, 48 bp, Artificial sequence
  Oligonucleotide: xAP298
gaattaagcttattataagcctaaggcttattgacttgcagcaacaag

SEQ ID NO: 52 - DNA, 48 bp, Artificial sequence
  Oligonucleotide: xAP299
gaattaagcttattataagcctaaggcagcttaacttgcagcaacaag

SEQ ID NO: 53 - DNA, 48 bp, Artificial sequence
  Oligonucleotide: xAP300
gaattaagcttattataagcctaaggcagcttgttatgcagcaacaag

SEQ ID NO: 54 - DNA, 48 bp, Artificial sequence
  Oligonucleotide: xAP301
gaattaagcttattataagcctaaggcagcttgactttaagcaacaag

SEQ ID NO: 55 - DNA, 56 bp, Artificial sequence
  Oligonucleotide: xAP302
gaattaagcttattataagcctaaggcagcttgacttgcttaaacaagttttttac

SEQ ID NO: 56 - DNA, 56 bp, Artificial sequence
  Oligonucleotide: xAP303
gaattaagcttattataagcctaaggcagcttgacttgcagcttaaagttttttac

SEQ ID NO: 57 - DNA, 60 bp, Artificial sequence
  Oligonucleotide: xAP304
gaattaagcttattataagcctaaggcagcttgacttgcagcaacttattttttaccctc

SEQ ID NO: 58 - DNA, 60 bp, Artificial sequence
  Oligonucleotide: xAP305
gaattaagcttattataagcctaaggcagcttgacttgcagcaacaagttatttaccctc

SEQ ID NO: 59 - DNA, 63 bp, Artificial sequence
  Oligonucleotide: xAP306
gaattaagcttattataagcctaaggcagcttgacttgcagcaacaagttttttttactcctc

SEQ ID NO: 60 - DNA, 74 bp, Artificial sequence
  Oligonucleotide: xAP307
gaattaagcttattataagcctaaggcagcttgacttgcagcaacaagttttttaccctcctcggcttagcagg

SEQ ID NO: 61 - DNA, 28 bp, Artificial sequence
  Oligonucleotide: xAP314
ctcaagaaacctaggaaaagtgggcagc

SEQ ID NO: 62 - protein, 585 aa, Artificial sequence
  HSA K574A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKALVAASQAALGL

SEQ ID NO: 63 - protein, 585 aa, Artificial sequence
  HSA Q580A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASAAALGL

SEQ ID NO: 64 - protein, 585 aa, Artificial sequence
  HSA K573P, Q580A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASAAALGL

SEQ ID NO: 65 - DNA, 48 bp, Artificial sequence
  Oligonucleotide xAP308
gaattaagcttattataagcctaaggcagcagcacttgcagcaacaag

SEQ ID NO: 66 - DNA, 60 bp, Artificial sequence
  Oligonucleotide xAP309
gaattaagcttattataagcctaaggcagcttgacttgcagcaacaagagctttaccctc

SEQ ID NO: 67 - DNA, 61 bp, Artificial sequence
  Oligonucleotide xAP311
gaattaagcttattataagcctaaggcagcagcacttgcagcaacaagttttggaccctcc

SEQ ID NO: 68 - protein, 585 aa, Artificial sequence
  HSA L575F
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKFVAASQAALGL

SEQ ID NO: 69 - protein, 585 aa, Artificial sequence
  HSA N503D
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFDAETFTFHADICTLSEKERQIKKQTALVELVKHKPKATKEQLKAVMDDFAAFVEKCCKADDKETCFAEEGKKLVAASQAALGL

SEQ ID NO: 70 - protein, 585 aa, Artificial sequence
  HSA E505Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAQTFTFHADICTLSEKERQIKKQTALVELVKHKPKATKEQLKAVMDDFAAFVEKCCKADDKETCFAEEGKKLVAASQAALGL

SEQ ID NO: 71 - protein, 585 aa, Artificial sequence
  HSA H510D
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFDADICTLSEKERQIKKQTALVELVKHKPKATKEQLKAVMDDFAAFVEKCCKADDKETCFAEEGKKLVAASQAALGL

SEQ ID NO: 72 - protein, 585 aa, Artificial sequence
  HSA H510E
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFEADICTLSEKERQIKKQTALVELVKHKPKATKEQLKAVMDDFAAFVEKCCKADDKETCFAEEGKKLVAASQAALGL

SEQ ID NO: 73 - protein, 585 aa, Artificial sequence
  HSA H512E
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHAEICTLSEKERQIKKQTALVELVKHKPKATKEQLKAVMDDFAAFVEKCCKADDKETCFAEEGKKLVAASQAALGL

SEQ ID NO: 74 - protein, 585 aa, Artificial sequence
  HSA D512A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHAAICTLSEKERQIKKQTALVELVKHKPKATKEQLKAVMDDFAAFVEKCCKADDKETCFAEEGKKLVAASQAALGL

SEQ ID NO: 75 - protein, 585 aa, Artificial sequence
  HSA E565V
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKVTCFAEEGKKLVAASQAALGL

SEQ ID NO: 76 - protein, 585 aa, Artificial sequence
  HSA A569V
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFVEEGKKLVAASQAALGL

SEQ ID NO: 77 - protein, 585 aa, Artificial sequence
  HSA A569L
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFLEEGKKLVAASQAALGL

SEQ ID NO: 78 - protein, 585 aa, Artificial sequence
  HSA V576F
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLFAASQAALGL

SEQ ID NO: 79 - protein, 585 aa, Artificial sequence
  HSA R410A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVAYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 80 - protein, 585 aa, Artificial sequence
  HSA Y411A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRATKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 81 - protein, 585 aa, Artificial sequence
  HSA P416A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVAQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 82 - protein, 585 aa, Artificial sequence
  HSA E425A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVAVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 83 - protein, 585 aa, Artificial sequence
  HSA E425K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVKVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 84 - protein, 585 aa, Artificial sequence
  HSA K524A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIAKQTALVELVKHKPKATKEQLKAVMDDFAAFVEKCCKADDKETCFAEEGKKLVAASQAALGL

SEQ ID NO: 85 - protein, 585 aa, Artificial sequence
  HSA K525A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKAQTALVELVKHKPKATKEQLKAVMDDFAAFVEKCCKADDKETCFAEEGKKLVAASQAALGL

SEQ ID NO: 86 - protein, 585 aa, Artificial sequence
  HSA K534V
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVVHKPKATKEQLKAVMDDFAAFVEKCCKADDKETCFAEEGKKLVAASQAALGL

SEQ ID NO: 87 - protein, 585 aa, Artificial sequence
  HSA H535F
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKFKPKATKEQLKAVMDDFAAFVEKCCKADDKETCFAEEGKKLVAASQAALGL

SEQ ID NO: 88 - protein, 585 aa, Artificial sequence
  HSA N503K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFKAETFTFHADICTLSEKERQIKKQTALVELVKHKPKATKEQLKAVMDDFAAFVEKCCKADDKETCFAEEGKKLVAASQAALGL

SEQ ID NO: 89 - protein, 585 aa, Artificial sequence
  HSA E505K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAKTFTFHADICTLSEKERQIKKQTALVELVKHKPKATKEQLKAVMDDFAAFVEKCCKADDKETCFAEEGKKLVAASQAALGL

SEQ ID NO: 90 - protein, 585 aa, Artificial sequence
  HSA A569S
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFSEEGKKLVAASQAALGL

SEQ ID NO: 91 - protein, 585 aa, Artificial sequence
  HSA K466A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEATPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 92 - protein, 585 aa, Artificial sequence
  HSA D471A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSARVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 93 - protein, 585 aa, Artificial sequence
  HSA R472A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDAVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 94 - protein, 585 aa, Artificial sequence
  HSA T527D
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQDALVELVKHKPKATKEQLKAVMDDFAAFVEKCCKADDKETCFAEEGKKLVAASQAALGL

SEQ ID NO: 95 - protein, 585 aa, Artificial sequence
  HSA T527M
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQMALVELVKHKPKATKEQLKAVMDDFAAFVEKCCKADDKETCFAEEGKKLVAASQAALGL

SEQ ID NO: 96 - protein, 585 aa, Artificial sequence
  HSA T527A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQAALVELVKHKPKATKEQLKAVMDDFAAFVEKCCKADDKETCFAEEGKKLVAASQAALGL

SEQ ID NO: 97 - protein, 585 aa, Artificial sequence
  HSA K190A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGAASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 98 - protein, 585 aa, Artificial sequence
  HSA R197A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQALKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 99 - DNA, 27 bp, Artificial sequence
  Oligonucleotide xAP437
tgagtccgcggaaaattgtgacaaatc

SEQ ID NO: 100 - DNA, 29 bp, Artificial sequence
  Oligonucleotide xAP438
gcagagctagcagccccttcatcccgaag

SEQ ID NO: 101 - DNA, 38 bp, Artificial sequence
  Oligonucleotide xAP439
ggaaggctagctctgccaaacaggctctcaagtgtgcc

SEQ ID NO: 102 - DNA, 26 bp, Artificial sequence
  Oligonucleotide xAP440
gatctccatggcagcattccgtgtgg

SEQ ID NO: 103 - DNA, 29 bp, Artificial sequence
  Oligonucleotide xAP441
tgctgccatggagatctgctcgagtgtgc

SEQ ID NO: 104 - DNA, 95 bp, Artificial sequence
  Oligonucleotide xAP442
catttggatcccacttttcctaggtttcttgagacctctacaagagttggagttgacacttggggtactttcttggtgtaagcaactaatagcgc

SEQ ID NO: 105 - DNA, 93 bp, Artificial sequence
  Oligonucleotide xAP443
catttggatcccacttttcctaggtttcttgagacctctacaagagttggagttgacacttggggtactttcttggtagcacgaactaatagc

SEQ ID NO: 106 - DNA, 76 bp, Artificial sequence
  Oligonucleotide xAP444
catttggatcccacttttcctaggtttcttgagacctctacaagagttggagttgacacttgagctactttcttgg

SEQ ID NO: 107 - DNA, 50 bp, Artificial sequence
  Oligonucleotide xAP445
catttggatcccacttttcctaggtttcttgagacagctacaagagttgg

SEQ ID NO: 108 - DNA, 50 bp, Artificial sequence
  Oligonucleotide xAP446
catttggatcccacttttcctaggtttcttgagacttttacaagagttgg

SEQ ID NO: 109 - DNA, 29 bp, Artificial sequence
  Oligonucleotide xAP449
agaaacctaggaaaagtgggatccaaatg

SEQ ID NO: 110 - DNA, 98 bp, Artificial sequence
  Oligonucleotide xAP450
tttcgtcgacttccagagctgaaaagcatggtcgcctgttcaccaaggattctgtgcagcatttggtgactctgtcacttactggcgtagcctcatgc

SEQ ID NO: 111 - DNA, 88 bp, Artificial sequence
  Oligonucleotide xAP451
gtttcgtcgacttccagagctgaaaagcatggtcgcctgttcaccaaggattctgtgcagcatttggtgactctagcacttactggcg

SEQ ID NO: 112 - DNA, 55 bp, Artificial sequence
  Oligonucleotide xAP452
ctctggaagtcgacgaaacatacgttcccaaagagtttgatgctgaaacattcac

SEQ ID NO: 113 - DNA, 31 bp, Artificial sequence
  Oligonucleotide xAP453
tattataagcctaaggcagcttgacttgcag

SEQ ID NO: 114 - DNA, 74 bp, Artificial sequence
  Oligonucleotide xAP455
ctctggaagtcgacgaaacatacgttcccaaagagtttaatgctgaaacattcaccttcgatgcagatatatgc

SEQ ID NO: 115 - DNA, 74 bp, Artificial sequence
  Oligonucleotide xAP456
ctctggaagtcgacgaaacatacgttcccaaagagtttaatgctgaaacattcaccttcgaagcagatatatgc

SEQ ID NO: 116 - DNA, 78 bp, Artificial sequence
  Oligonucleotide xAP457
ctctggaagtcgacgaaacatacgttcccaaagagtttaatgctgaaacattcaccttccatgcagaaatatgcacac

SEQ ID NO: 117 - DNA, 78 bp, Artificial sequence
  Oligonucleotide xAP458
ctctggaagtcgacgaaacatacgttcccaaagagtttaatgctgaaacattcaccttccatgcagctatatgcacac

SEQ ID NO: 118 - DNA, 50 bp, Artificial sequence
  Oligonucleotide xAP459
ttcacgagctcaacaagtgcagtttgtttagcgatttgtctctccttctc

SEQ ID NO: 119 - DNA, 50 bp, Artificial sequence
  Oligonucleotide xAP460
ttcacgagctcaacaagtgcagtttgagccttgatttgtctctccttctc

SEQ ID NO: 120 - DNA, 33 bp, Artificial sequence
  Oligonucleotide xAP461
ttcacgagctcaacaagtgcatcttgtttcttg

SEQ ID NO: 121 - DNA, 29 bp, Artificial sequence
  Oligonucleotide xAP463
ttgttgagctcgtggttcacaagcccaag

SEQ ID NO: 122 - DNA, 30 bp, Artificial sequence
  Oligonucleotide xAP471
ttgttgagctcgtgaaatttaagcccaagg

SEQ ID NO: 123 - DNA, 27 bp, Artificial sequence
  Oligonucleotide xAP472
ctggaagtcgacgaaacatacgttccc

SEQ ID NO: 124 - DNA, 75 bp, Artificial sequence
  Oligonucleotide xAP473
ataagcctaaggcagcttgacttgcagcaacaagttttttaccctcctcggcaaagcaggtaaccttatcgtcag

SEQ ID NO: 125 - DNA, 62 bp, Artificial sequence
  Oligonucleotide xAP481
ataagcctaaggcagcttgacttgcagcaacaagttttttaccctcctcaacaaagcaggtc

SEQ ID NO: 126 - DNA, 62 bp, Artificial sequence
  Oligonucleotide xAP482
ataagcctaaggcagcttgacttgcagcaacaagttttttaccctcctccaaaaagcaggtc

SEQ ID NO: 127 - DNA, 43 bp, Artificial sequence
  Oligonucleotide xAP489
ataagcctaaggcagcttgacttgcagcaaaaagttttttacc

SEQ ID NO: 128 - DNA, 85 bp, Artificial sequence
  Oligonucleotide xAP490
gtttcgtcgacttccagagctgaaaagcatggtcgcctgttcaccaaggattctgtgcagcatttggtgacagcgtcacttactg

SEQ ID NO: 129 - DNA, 53 bp, Artificial sequence
  Oligonucleotide xAP491
tggaagtcgacgaaacatacgttcccaaagagtttaatgctcaaacattcacc

SEQ ID NO: 130 - DNA, 60 bp, Artificial sequence
  Oligonucleotide xAP492
tggaagtcgacgaaacatacgttcccaaagagtttaatgctaaaacattcaccttccatg

SEQ ID NO: 131 - DNA, 60 bp, Artificial sequence
  Oligonucleotide xAP493
tggaagtcgacgaaacatacgttcccaaagagtttaaagctgaaacattcaccttccatg

SEQ ID NO: 132 - DNA, 70 bp, Artificial sequence
  Oligonucleotide xAP494
ataagcctaaggcagcttgacttgcagcaacaagttttttaccctcctcagaaaagcaggtctccttatc

SEQ ID NO: 133 - DNA, 50 bp, Artificial sequence
  Oligonucleotide xAP495
gtttcacgagctcaacaagtgccatttgtttcttgatttgtctctccttc

SEQ ID NO: 134 - DNA, 50 bp, Artificial sequence
  Oligonucleotide xAP496
gtttcacgagctcaacaagtgcagcttgtttcttgatttgtctctccttc

SEQ ID NO: 135 - protein, 585 aa, Artificial sequence
  HSA E425A, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVAVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 136 - protein, 585 aa, Artificial sequence
  HSA T527M, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQMALVELVKHKPKATKEQLKAVMDDFAAFVEKCCKADDKETCFAEEGPKLVAASQAALGL

SEQ ID NO: 137 - protein, 585 aa, Artificial sequence
  HSA E505Q, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAQTFTFHADICTLSEKERQIKKQTALVELVKHKPKATKEQLKAVMDDFAAFVEKCCKADDKETCFAEEGPKLVAASQAALGL

SEQ ID NO: 138 - protein, 585 aa, Artificial sequence
  HSA N111D, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPDLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 139 - protein, 585 aa, Artificial sequence
  HSA N111G, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPGLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 140 - protein, 585 aa, Artificial sequence
  HSA N111H, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPHLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 141 - protein, 585 aa, Artificial sequence
  HSA N111R, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPRLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 142 - protein, 585 aa, Artificial sequence
  HSA N111Q, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPQLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 143 - protein, 585 aa, Artificial sequence
  HSA N111E, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPELPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 144 - protein, 585 aa, Artificial sequence
  HSA K534V, K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVVHKPKATKEQLKAVMDDFAAFVEKCCKADDKETCFAEEGPKLVAASQAALGL

SEQ ID NO: 145 - protein, 387 aa, Artificial sequence
  HSA domain 1 and domain 2
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNL

SEQ ID NO: 146 - protein, 585 aa, Artificial sequence
  HSA Q417A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPAVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 147 - protein, 585 aa, Artificial sequence
  HSA H440Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKQPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 148 - protein, 585 aa, Artificial sequence
  HSA H464Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLQEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 149 - protein, 585 aa, Artificial sequence
  HSA D494N (Casebrook)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVNETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 150 - protein, 584 aa, Artificial sequence
  HSA D494A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVAETYVPKEFNAETFTFHADICTLSEKERQIKKQTALVELVKHKPKATKEQLKAVMDDFAAFVEKCCKADDKETCFAEEGKKLVAASQAALG

SEQ ID NO: 151 - protein, 585 aa, Artificial sequence
  HSA D494Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVQETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 152 - protein, 585 aa, Artificial sequence
  HSA E495Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDQTYVPKEFNAETFTFHADICTLSEKERQIKKQTALVELVKHKPKATKEQLKAVMDDFAAFVEKCCKADDKETCFAEEGKKLVAASQAALGL

SEQ ID NO: 153 - protein, 585 aa, Artificial sequence
  HSA E495A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDATYVPKEFNAETFTFHADICTLSEKERQIKKQTALVELVKHKPKATKEQLKAVMDDFAAFVEKCCKADDKETCFAEEGKKLVAASQAALGL

SEQ ID NO: 154 - protein, 585 aa, Artificial sequence
  HSA T496A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDEAYVPKEFNAETFTFHADICTLSEKERQIKKQTALVELVKHKPKATKEQLKAVMDDFAAFVEKCCKADDKETCFAEEGKKLVAASQAALGL

SEQ ID NO: 155 - protein, 585 aa, Artificial sequence
  HSA D494N, T496A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVNEAYVPKEFNAETFTFHADICTLSEKERQIKKQTALVELVKHKPKATKEQLKAVMDDFAAFVEKCCKADDKETCFAEEGKKLVAASQAALGL

SEQ ID NO: 156 - protein, 585 aa, Artificial sequence
  HSA HSA T83N
DAHKSEVAHRFKDLGEENFKALVLIAFAQYLQQCPFEDHVKLVNEVTEFAKTCVADESAENCDKSLHTLFGDKLCTVATLRENYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 157 - protein, 585 aa, Artificial sequence
  HSA P499A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVAKEFNAETFTFHADICTLSEKERQIKKQTALVELVKHKPKATKEQLKAVMDDFAAFVEKCCKADDKETCFAEEGKKLVAASQAALGL

SEQ ID NO: 158 - protein, 585 aa, Artificial sequence
  HSA K500A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPAEFNAETFTFHADICTLSEKERQIKKQTALVELVKHKPKATKEQLKAVMDDFAAFVEKCCKADDKETCFAEEGKKLVAASQAALGL

SEQ ID NO: 159 - protein, 585 aa, Artificial sequence
  HSA E501A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKAFNAETFTFHADICTLSEKERQIKKQTALVELVKHKPKATKEQLKAVMDDFAAFVEKCCKADDKETCFAEEGKKLVAASQAALGL

SEQ ID NO: 160 - protein, 585 aa, Artificial sequence
  HSA H510Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFQADICTLSEKERQIKKQTALVELVKHKPKATKEQLKAVMDDFAAFVEKCCKADDKETCFAEEGKKLVAASQAALGL

SEQ ID NO: 161 - protein, 585 aa, Artificial sequence
  HSA H535Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKQKPKATKEQLKAVMDDFAAFVEKCCKADDKETCFAEEGKKLVAASQAALGL

SEQ ID NO: 162 - protein, 585 aa, Artificial sequence
  HSA K536A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHAPKATKEQLKAVMDDFAAFVEKCCKADDKETCFAEEGKKLVAASQAALGL

SEQ ID NO: 163 - protein, 585 aa, Artificial sequence
  HSA P537A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKAKATKEQLKAVMDDFAAFVEKCCKADDKETCFAEEGKKLVAASQAALGL

SEQ ID NO: 164 - protein, 585 aa, Artificial sequence
  HSA K538A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPAATKEQLKAVMDDFAAFVEKCCKADDKETCFAEEGKKLVAASQAALGL

SEQ ID NO: 165 - protein, 505 aa, Artificial sequence
  HSA DIIIa
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAE

SEQ ID NO: 166 - protein, 585 aa, Artificial sequence
  HSA E531H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVHLVKHKPKATKEQLKAVMDDFAAFVEKCCKADDKETCFAEEGKKLVAASQAALGL

SEQ ID NO: 167 - protein, 585 aa, Artificial sequence
  HSA E531A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVALVKHKPKATKEQLKAVMDDFAAFVEKCCKADDKETCFAEEGKKLVAASQAALGL

SEQ ID NO: 168 - protein, 585 aa, Artificial sequence
  HSA D108A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDANPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 169 - protein, 585 aa, Artificial sequence
  HSA N111K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPKLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 170 - protein, 585 aa, Artificial sequence
  HSA N111D
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPDLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 171 - protein, 585 aa, Artificial sequence
  HSA N111G
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPGLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 172 - protein, 585 aa, Artificial sequence
  HSA N111H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPHLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 173 - protein, 585 aa, Artificial sequence
  HSA K276N
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLNECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 174 - protein, 585 aa, Artificial sequence
  HSA N111R
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPRLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 175 - protein, 585 aa, Artificial sequence
  HSA N111Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPQLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 176 - protein, 585 aa, Artificial sequence
  HSA N111E
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPELPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 177 - protein, 585 aa, Artificial sequence
  HSA N109D
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDDPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 178 - protein, 585 aa, Artificial sequence
  HSA N109E
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDEPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 179 - protein, 585 aa, Artificial sequence
  HSA N109Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDQPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 180 - protein, 585 aa, Artificial sequence
  HSA N109R
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDRPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 181 - protein, 585 aa, Artificial sequence
  HSA N109K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDKPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 182 - protein, 585 aa, Artificial sequence
  HSA N109H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDHPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 183 - protein, 585 aa, Artificial sequence
  HSA N109G
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDGPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 184 - protein, 585 aa, Artificial sequence
  HSA N108E
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDENPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

What is claimed is:

1. A polypeptide which is a variant of albumin, comprising one or more alterations at one or more positions corresponding to 104, 106, 108, 109, 110, and 120 in SEQ ID NO: 2 with one or more of A, C, D, E, F, G, H, I, K, L, M, N, P, Q, R, S, T, V, W, Y.

2. The polypeptide according to claim 1 wherein the one or more alterations are substitution(s).

3. The polypeptide according to claim 1, comprising a conjugatable thiol group on the polypeptide.

4. A fragment of the polypeptide according to claim 1, wherein the polypeptide is a fragment with at least 500 amino acids.

5. A fusion polypeptide, conjugate, associate, nanoparticle, microparticle or composition comprising the polypeptide of claim 1.

6. The polypeptide according to claim 1, wherein the sequence identity of the polypeptide to SEQ ID NO: 2 is more than 97%.

7. The polypeptide according to claim 1, wherein the sequence identity of the polypeptide to SEQ ID NO: 2 is more than 99%.

8. The polypeptide of claim 1, wherein one alteration corresponds to position 104 in SEQ ID NO: 2 with one of A, C, D, E, F, G, H, I, K, L, M, N, P, Q, R, S, T, V, W, Y.

9. The polypeptide of claim 1, wherein one alteration corresponds to position 106 in SEQ ID NO: 2 with one of A, C, D, E, F, G, H, I, K, L, M, N, P, Q, R, S, T, V, W, Y.

10. The polypeptide of claim 1, wherein one alteration corresponds to position 108 in SEQ ID NO: 2 with one of A, C, D, E, F, G, H, I, K, L, M, N, P, Q, R, S, T, V, W, Y.

11. The polypeptide of claim 1, wherein one alteration corresponds to position 109 in SEQ ID NO: 2 with one of A, C, D, E, F, G, H, I, K, L, M, N, P, Q, R, S, T, V, W, Y.

12. The polypeptide of claim 1, wherein one alteration corresponds to position 110 in SEQ ID NO: 2 with one of A, C, D, E, F, G, H, I, K, L, M, N, P, Q, R, S, T, V, W, Y.

13. The polypeptide of claim 1, wherein one alteration corresponds to position 120 in SEQ ID NO: 2 with one of A, C, D, E, F, G, H, I, K, L, M, N, P, Q, R, S, T, V, W, Y.

14. A method of making a polypeptide according to claim 1 comprising:

(a) providing a nucleic acid encoding a parent albumin comprising the sequence of SEQ ID NO: 2;

(b) modifying the sequence of step (a), to encode a polypeptide which is a variant albumin having one or more substitutions at one or more position corresponding to positions in SEQ ID NO: 2 selected from the group consisting of: 104, 106, 108, 109, 110, and 120.

15. The method of claim 14 further comprising:

(c) introducing the modified sequence of step (b) in a suitable host cell;

(d) growing the cells in a suitable growth medium under condition leading to expression of the polypeptide; and (e) recovering the polypeptide from the growth medium.

* * * * *